US009611322B2

(12) United States Patent
Wilson, Jr. et al.

(10) Patent No.: US 9,611,322 B2
(45) Date of Patent: Apr. 4, 2017

(54) FUSIONS OF ANTIBODIES TO CD38 AND ATTENUATED INTERFERON ALPHA

(71) Applicant: Teva Pharmaceuticals Australia Pty Ltd, Macquarie Park, NSW (AU)

(72) Inventors: David S. Wilson, Jr., Freemont, CA (US); Sarah L. Pogue, Freemont, CA (US); Glen E. Mikesell, Pacifica, CA (US); Tetsuya Taura, Palo Alto, CA (US); Wouter Korver, Mountain View, CA (US); Anthony G. Doyle, Drummoyne (AU); Adam Clarke, Five Dock (AU); Matthew Pollard, Dural (AU); Stephen Tran, Strathfield South (AU); Jack Tzu Chiao Lin, Redwood City, CA (US)

(73) Assignee: Teva Pharmaceuticals Australia Pty Ltd, Macquarie Park, NSW (AU)

( * ) Notice: Subject to any disclaimer, the term of this patent is extended or adjusted under 35 U.S.C. 154(b) by 0 days.

(21) Appl. No.: 14/262,841

(22) Filed: Apr. 28, 2014

(65) Prior Publication Data

US 2014/0248238 A1    Sep. 4, 2014

Related U.S. Application Data

(63) Continuation of application No. PCT/AU2012/001323, filed on Oct. 29, 2012.

(30) Foreign Application Priority Data

Oct. 28, 2011    (AU) ................. 2011904502

(51) Int. Cl.

| C07K 16/28 | (2006.01) |
|---|---|
| C07K 16/46 | (2006.01) |
| C07K 14/56 | (2006.01) |
| C07K 14/54 | (2006.01) |
| C07K 14/565 | (2006.01) |
| C07K 14/57 | (2006.01) |
| C07K 16/10 | (2006.01) |

(52) U.S. Cl.
CPC .......... *C07K 16/28* (2013.01); *C07K 14/5406* (2013.01); *C07K 14/5412* (2013.01); *C07K 14/56* (2013.01); *C07K 14/565* (2013.01); *C07K 14/57* (2013.01); *C07K 16/1027* (2013.01); *C07K 16/2887* (2013.01); *C07K 16/2896* (2013.01); *C07K 16/46* (2013.01); *C07K 2317/24* (2013.01); *C07K 2317/33* (2013.01); *C07K 2317/92* (2013.01); *C07K 2319/00* (2013.01)

(58) Field of Classification Search
None
See application file for complete search history.

(56) References Cited

U.S. PATENT DOCUMENTS

| 5,055,289 A | 10/1991 | Frincke |
|---|---|---|
| 5,650,150 A | 7/1997 | Gillies |
| 6,800,735 B2 | 10/2004 | Whitty |
| 7,091,321 B2 | 8/2006 | Gillies |
| 7,670,595 B2 | 3/2010 | Gillies |
| 7,790,415 B2 | 9/2010 | Gillies |
| 8,980,267 B2 | 3/2015 | Grewal et al. |
| 9,139,634 B2 | 9/2015 | Morrison |
| 2002/0164788 A1 | 11/2002 | Ellis et al. |
| 2002/0193569 A1 | 12/2002 | Hanna |
| 2006/0269516 A1 | 11/2006 | Presta et al. |
| 2010/0172868 A1 | 7/2010 | Morrison et al. |
| 2010/0189689 A1 | 7/2010 | Chang et al. |
| 2015/0203560 A1 | 7/2015 | Grewel |

FOREIGN PATENT DOCUMENTS

| WO | 9724137 | 7/1997 |
|---|---|---|
| WO | 0040265 | 7/2000 |
| WO | 0197844 | 12/2001 |
| WO | 2005103083 | 11/2005 |
| WO | 2006099875 | 9/2006 |
| WO | 2007042309 | 4/2007 |
| WO | 2008124086 | 10/2008 |
| WO | 2009017823 | 2/2009 |
| WO | 2011154453 | 12/2011 |
| WO | 2012092612 | 7/2012 |
| WO | 2013059885 | 5/2013 |
| WO | 2013107791 | 7/2013 |
| WO | 2014028502 | 2/2014 |

OTHER PUBLICATIONS

Bork, 2000, Genome Research 10:398-400.*
Bork et al., 1996, Trends in Genetics 12:425-427.*
Wells, 1990, Biochemistry 29:8509-8517.*
Ngo et al., 1994, The Protein Folding Problem and Tertiary Structure Prediction, pp. 492-495.*
Tomoyuki, et al., "Engineering the variable region of therapeutic IgG antibodies", MABS, Landes Bioscience, US, vol. 3, No. 3, May 1, 2011, p. 243-252.
Kodama, et al., "Mutated SEA-D227A-conjgated antibodies greatly enhance antitumor activity against MUC1-expressing bile duct carcinoma", Cancer Immunology, Immnotherapy, vol. 50, No. 10, Dec. 2001, pp. 539-548.
Piehler, et al., "New structural and functional aspects of the Type 1 interferon-receptor interaction revealed by comprehensive mutational analysis of the binding interface", vol. 275, No. 51, Dec. 2000, pp. 40425-40433.
International Search Report and Written Opinion from related application PCT/AU2012/001323 dated Mar. 13, 2013.
International Search Report and Written Opinion from related application PCT/US2013/038659 dated Feb. 12, 2014.

* cited by examiner

Primary Examiner — Christine J Saoud
Assistant Examiner — Jegatheesan Seharaseyon
(74) Attorney, Agent, or Firm — Stradley Ronon Stevens & Young, LLP

(57) ABSTRACT

The present invention provides a polypeptide construct comprising a peptide or polypeptide signaling ligand linked to an antibody or antigen binding portion thereof which binds to a cell surface-associated antigen, wherein the ligand comprises at least one amino acid substitution or deletion which reduces its potency on cells lacking expression of said antigen.

18 Claims, 62 Drawing Sheets

FIGURE 3

Human CD38 (SEQ ID NO:131):

```
  1 MANCEFSPVSGDKPCCRLSRRAQLCLGVSILVLILVVVLAVVVPRWRQQWSGPGTTKRFP  60
 61 ETVLARCVKYTEIHPEMRHVDCQSVWDAFKGAFISKHPCNITEEDYQPLMKLGTQTVPCN 120
121 KILLWSRIKDLAHQFTQVQRDMFTLEDTLLGYLADDLTWCGEFNTSKINYQSCPDWRKDC 180
181 SNNPVSVFWKTVSRRFAEAACDVVHVMLNGSRSKIFDKNSTFGSVEVHNLQPEKVQTLEA 240
241 WVIHGGREDSRDLCQDPTIKELESIISKRNIQFSCKNIYRPDKFLQCVKNPEDSSCTSEI 300
``` underlined: extracellular domain
*italic: transmembrane domain*

FIGURE 4a
Sequence of IFNα2b (SEQ ID NO:3)

```
human IFNa2b     1  CDLPQTHSLG SRRTLMLLAQ MRRISLFSCL KDRHDFGFPQ EEFGNQFQKA ETIPVLHEMI QQIFNLFSTK DSSAAWDETL   80
(SEQ ID NO:3)
                81  LDKFYTELYQ QLNDLEACVI QGVGVTETPL MKEDSILAVR KYFQRITLYL KEKKYSPCAW EVVRAEIMRS FSLSTNLQES  160
               161  LRSKE                                                                                  165
```

Sequence of IFNβ1 (SEQ ID NO:91)

```
human IFNβ1      1  MSYNLLGFLQ RSSNFQCQKL LWQLNGRLEY CLKDRMNFDI PEEIKQLQQF QKEDAALTIY EMLQNIFAIF RQDSSSTGWN   80
(SEQ ID NO:91)
                81  ETIVENLLAN VYHQINHLKT VLEEKLEKED FTRGKLMSSL HLKRYYGRIL HYLKAKEYSH CAWTIVRVEI LRNFYFINRL  160
               161  TGYLRN                                                                                 166
```

Sequence of IFNβ1b (SEQ ID NO:103)

```
human IFNβ1b     1  MSYNLLGFLQ RSSNFQSQKL LWQLNGRLEY CLKDRMNFDI PEEIKQLQQF QKEDAALTIY EMLQNIFAIF RQDSSSTGWN   80
(SEQ ID NO:103)
                81  ETIVENLLAN VYHQINHLKT VLEEKLEKED FTRGKLMSSL HLKRYYGRIL HYLKAKEYSH CAWTIVRVEI LRNFYFINRL  160
               161  TGYLRN                                                                                 166
```

Sequence of IFNγ (SEQ ID NO:106)

```
human IFNγ       1  QDPYVKEAEN LKKYFNAGHS DVADNGTLFL GILKNWKEES DRKIMQSQIV SFYFKLFKNF KDDQSIQKSV ETIKEDMNVK   80
(SEQ ID NO:106)
                81  FFNSNKKKRD DFEKLTNYSV TDLNVQRKAI HELIQVMAEL SPAAKTGKRK RSQMLFRGRR ASQ                    143
```

FIGURE 4b
Sequence of IL-4 (SEQ ID NO:119)

```
human IL-4       1  HKCDITLQEI IKTLNSLTEQ KTLCTELTVT DIFAASKNTT EKETFCRAAT VLRQFYSHHE KDTRCLGATA QQFHRHKQLI   80
(SEQ ID NO:119)
                81  RFLKRLDRNL WGLAGLNSCP VKEANQSTLE NFLERLKTIM REKYSKCSS                                   129
```

Sequence of IL-6 (SEQ ID NO:123)

```
human IL-6       1  PVPPGEDSKD VAAPHRQPLT SSERIDKQIR YILDGISALR KETCNKSNMC ESSKEALAEN NLNLPKMAEK DGCFQSGFNE   80
(SEQ ID NO:123)
                81  ETCLVKIITG LLEFEVYLEY LQNRFESSEE QARAVQMSTK VLIQFLQKKA KNLDAITTPD PTTNASLLTK LQAQNQWLQD  160
               161  MTTHLILRSF KEFLQSSLRA LRQM                                                              184
```

FIGURE 5a

Heavy chain (SEQ ID NO:180):

```
  1 EVQLLESGGGLVQPGGSLRLSCAVSGFTFNSFAMSWVRQAPGKGLEWVSAISGSGGGTYY  60
 61 ADSVKGRFTISRDNSKNTLYLQMNSLRAEDTAVYFCAKDKILWFGEPVFDYWGQGTLVTV 120
121 SSASTKGPSVFPLAPCSRSTSESTAALGCLVKDYFPEPVTVSWNSGALTSGVHTFPAVLQ 180
181 SSGLYSLSSVVTVPSSSLGTKTYTCNVDHKPSNTKVDKRVESKYGPPCPPCPAPEFLGGP 240
241 SVFLFPPKPKDTLMISRTPEVTCVVVDVSQEDPEVQFNWYVDGVEVHNAKTKPREEQFNS 300
301 TYRVVSVLTVLHQDWLNGKEYKCKVSNKGLPSSIEKTISKAKGQPREPQVYTLPPSQEEM 360
361 TKNQVSLTCLVKGFYPSDIAVEWESNGQPENNYKTTPPVLDSDGSFFLYSRLTVDKSRWQ 420
421 EGNVFSCSVMHEALHNHYTQKSLSLSLGKCDLPQTHSLGSRRTLMLLAQMRRISLFSCLK 480
481 DRHDFGFPQEEFGNQFQKAETIPVLHEMIQQIFNLFSTKDSSAAWDETLLDKFYTELYQQ 540
541 LNDLEACVIQGVGVTETPLMKEDSILAVRKYFQRITLYLKEKKYSPCAWEVVRDEIMRSF 600
601 SLSTNLQESLRSKE                                               614
```

Light chain (SEQ ID NO:134):

```
  1 EIVLTQSPATLSLSPGERATLSCRASQSVSSYLAWYQQKPGQAPRLLIYDASNRATGIPA  60
 61 RFSGSGSGTDFTLTISSLEPEDFAVYYCQQRSNWPPTFGQGTKVEIKRTVAAPSVFIFPP 120
121 SDEQLKSGTASVVCLLNNFYPREAKVQWKVDNALQSGNSQESVTEQDSKDSTYSLSSTLT 180
181 LSKADYEKHKVYACEVTHQGLSSPVTKSFNRGEC                           214
``` double underlined: antibody heavy and light chains
single underlined: cytokine
single underlined & bold: attenuating mutation

G005-HC-L0-IFNα(A145D) IgG4

FIGURE 5b

Heavy chain (SEQ ID NO:330):

```
  1 QVQLQQSGSELMMPGASVKISCKATGYTFSNYWIEWVKQRPGHGLEWIGEILPGTGRTIY   60
 61 NEKFKGKATFTADISSNTVQMQLSSLTSEDSAVYYCARRDYYGNFYYAMDYWGQGTSVTV  120
121 SSASTKGPSVFPLAPCSRSTSESTAALGCLVKDYFPEPVTVSWNSGALTSGVHTFPAVLQ  180
181 SSGLYSLSSVVTVPSSSLGTKTYTCNVDHKPSNTKVDKRVESKYGPPCPPCPAPEFLGGP  240
241 SVFLFPPKPKDTLMISRTPEVTCVVVDVSQEDPEVQFNWYVDGVEVHNAKTKPREEQFNS  300
301 TYRVVSVLTVLHQDWLNGKEYKCKVSNKGLPSSIEKTISKAKGQPREPQVYTLPPSQEEM  360
361 TKNQVSLTCLVKGFYPSDIAVEWESNGQPENNYKTTPPVLDSDGSFFLYSRLTVDKSRWQ  420
421 EGNVFSCSVMHEALHNHYTQKSLSLSLGKCDLPQTHSLGSRRTLMLLAQMRRISLFSCLK  480
481 DRHDFGFPQEEFGNQFQKAETIPVLHEMIQQIFNLFSTKDSSAAWDETLLDKFYTELYQQ  540
541 LNDLEACVIQGVGVTETPLMKEDSILAVRKYFQRITLYLKEKKYSPCAWEVVRDEIMRSF  600
601 SLSTNLQESLRSKE                                               614
```

Light chain (SEQ ID NO:326):

```
  1 DIQMTQSTSSLSASLGDRVTISCSASQGINNYLNWYQQKPDGTVELLIYYTSTLQSGVPS   60
 61 RFSGSGSGTDYSLTISNLEPEDIGTYYCQQYSKLPRTFGGGTKLEIKRTVAAPSVFIFPP  120
121 SDEQLKSGTASVVCLLNNFYPREAKVQWKVDNALQSGNSQESVTEQDSKDSTYSLSSTLT  180
181 LSKADYEKHKVYACEVTHQGLSSPVTKSFNRGEC                           214
``` double underlined: antibody heavy and light chains
single underlined: cytokine
single underlined & bold: attenuating mutation nBT062-HC-L0-IFNα(A145D) IgG4

FIGURE 5c

Heavy chain (SEQ ID NO:214):

```
  1 EVQLLESGGGLVQPGGSLRLSCAVSGFTFNSFAMSWVRQAPGKGLEWVSAISGSGGGTYY  60
 61 ADSVKGRFTISRDNSKNTLYLQMNSLRAEDTAVYFCAKDKILWFGEPVFDYWGQGTLVTV 120
121 SSASTKGPSVFPLAPCSRSTSESTAALGCLVKDYFPEPVTVSWNSGALTSGVHTFPAVLQ 180
181 SSGLYSLSSVVTVPSSSLGTKTYTCNVDHKPSNTKVDKRVESKYGPPCPPCPAPEFLGGP 240
241 SVFLFPPKPKDTLMISRTPEVTCVVVDVSQEDPEVQFNWYVDGVEVHNAKTKPREEQFNS 300
301 TYRVVSVLTVLHQDWLNGKEYKCKVSNKGLPSSIEKTISKAKGQPREPQVYTLPPSQEEM 360
361 TKNQVSLTCLVKGFYPSDIAVEWESNGQPENNYKTTPPVLDSDGSFFLYSRLTVDKSRWQ 420
421 EGNVFSCSVMHEALHNHYTQKSLSLSLGKMSYNLLGFLQRSSNFQSQKLLWQLNGRLEYC 480
481 LKDAMNFDIPEEIKQLQQFQKEDAALTIYEMLQNIFAIFRQDSSSTGWNETIVENLLANV 540
541 YHQINHLKTVLEEKLEKEDFTRGKLMSSLHLKRYYGRILHYLKAKEYSHCAWTIVRVEIL 600
601 RNFYFINRLTGYLRN                                              615
```

Light chain (SEQ ID NO:134):

```
  1 EIVLTQSPATLSLSPGERATLSCRASQSVSSYLAWYQQKPGQAPRLLIYDASNRATGIPA  60
 61 RFSGSGSGTDFTLTISSLEPEDFAVYYCQQRSNWPPTFGQGTKVEIKRTVAAPSVFIFPP 120
121 SDEQLKSGTASVVCLLNNFYPREAKVQWKVDNALQSGNSQESVTEQDSKDSTYSLSSTLT 180
181 LSKADYEKHKVYACEVTHQGLSSPVTKSFNRGEC                           214
``` double underlined: antibody heavy and light chains
single underlined: cytokine
single underlined & bold: attenuating mutation

G005-HC-L0-IFNβ(R35A) IgG4

FIGURE 5d

Heavy chain (SEQ ID NO:324):

```
  1 QVQLKQSGPGLVQPSQSLSLTCTVSGFSLTSYGVHWVRQPPGKGLEWLGVIWSGGSTDYN  60
 61 AAFISRLSIRKDNSKSQVFFKMNSLQADDTAIYYCARTFTTSTSAWFAYWGQGTLVTVSA 120
121 ASTKGPSVFPLAPSSKSTSGGTAALGCLVKDYFPEPVTVSWNSGALTSGVHTFPAVLQSS 180
181 GLYSLSSVVTVPSSSLGTQTYICNVNHKPSNTKVDKKVEPKSCDKTHTCPPCPAPELLGG 240
241 PSVFLFPPKPKDTLMISRTPEVTCVVVDVSHEDPEVKFNWYVDGVEVHNAKTKPREEQYN 300
301 STYRVVSVLTVLHQDWLNGKEYKCKVSNKALPAPIEKTISKAKGQPREPQVYTLPPSRDE 360
361 LTKNQVSLTCLVKGFYPSDIAVEWESNGQPENNYKTTPPVLDSDGSFFLYSKLTVDKSRW 420
421 QQGNVFSCSVMHEALHNHYTQKSLSLSPGK*SGGGGSGGGGSGGGGS*PVPPGEDSKDVAAP 480
481 HRQPLTSSERIDKQIRYILDGISALRKETCNKSNMCESSKEALAENNLNLPKMAEKDGCF 540
541 QSGFNEETCLVKIITGLLEFEVYLEYLQNRFESSEEQARAVQMSTKVLIQFLQKKAKNLD 600
601 AITTPDPTTNASLLTKLQAQNQWLQDMTTHLILRSFKEFLQSSLEALRQM           650
```

Light chain (SEQ ID NO:312):

```
  1 SIVMTQTPKFLLVSAGDRVTITCKASQSVSNDVAWYQQKPGQSPKLLIYYASNRYTGVPD  60
 61 RFTGSGYGTDFTFTISTVQAEDLAVYFCQQDYSSPPWTFGGGTKLEIRRTVAAPSVFIFP 120
121 PSDEQLKSGTASVVCLLNNFYPREAKVQWKVDNALQSGNSQESVTEQDSKDSTYSLSSTL 180
181 TLSKADYEKHKVYACEVTHQGLSSPVTKSFNRGEC                          215
``` double underlined: antibody heavy and light chains
single underlined: cytokine
single underlined & bold: attenuating mutation
*italic: linker sequence*

HB95-HC-L16-IL-6(R179E) IgG1

FIGURE 5e

Heavy chain (SEQ ID NO:306):

```
  1  DVQLQESGPGLVKPSQSLSLTCTVTGHSITSDYAWNWIRQFPGDKLEWMGYISYSGYTTY   60
 61  NPSLKSRVSITRDTSKNQFFLQLNSVTTEDTATYFCARDLDYGPWFAYWGQGTLVTVSAA  120
121  STKGPSVFPLAPSSKSTSGGTAALGCLVKDYFPEPVTVSWNSGALTSGVHTFPAVLQSSG  180
181  LYSLSSVVTVPSSSLGTQTYICNVNHKPSNTKVDKKVEPKSCDKTHTCPPCPAPELLGGP  240
241  SVFLFPPKPKDTLMISRTPEVTCVVVDVSHEDPEVKFNWYVDGVEVHNAKTKPREEQYNS  300
301  TYRVVSVLTVLHQDWLNGKEYKCKVSNKALPAPIEKTISKAKGQPREPQVYTLPPSRDEL  360
361  TKNQVSLTCLVKGFYPSDIAVEWESNGQPENNYKTTPPVLDSDGSFFLYSKLTVDKSRWQ  420
421  QGNVFSCSVMHEALHNHYTQKSLSLSPGK*SGGGGS*HKCDITLQEIIKTLNSLTEQKTLCT  480
481  ELTVTDIFAASKNTTEKETFCRAATVLRQFYSHHEKDTRCLGATAQQFHRHKQLIRFLKR  540
541  LDQNLWGLAGLNSCPVKEANQSTLENFLERLKTIMREKYSKCSS                 584
```

Light chain (SEQ ID NO:300):

```
  1  DIQMTQSPASLSASVGETVTLTCRASENIHNYLAWYQQKQGKSPQLLVYNVKTLADGVPS   60
 61  RFSGSGSGTQYSLKINSLQPEDFGSYYCQHFWSSPWTFGGGTKVEIKRTVAAPSVFIFPP  120
121  SDEQLKSGTASVVCLLNNFYPREAKVQWKVDNALQSGNSQESVTEQDSKDSTYSLSSTLT  180
181  LSKADYEKHKVYACEVTHQGLSSPVTKSFNRGEC                              214
``` double underlined: antibody heavy and light chains
single underlined: cytokine
single underlined & bold: attenuating mutation
*italic: linker sequence*

J110-HC-L6-IL-4(R88Q) IgG1

FIGURE 13

```
X355/02 VH (SEQ ID NO:391):
    1 QLQLQESGPGLVKPSETLSLTCTVSGGSISSSSYYWSWIRQHPGKGLEWIGYIYYSGSTN   60
   61 YNPSLKSRVTISVDTLKNQISLRLTSVTAADTAVYYCARVGGAGGWPMDVWGQGTTVTVS  120
  121 S                                                            121
X355/02 Vλ (SEQ ID NO:390):
    1 QAVLTQPASLSASPGESARLTCTLPSDINVRYYNIYWYQQKPGSPPRYLLYYYSDSHKGQ   60
   61 GSGVPSRFSGSKDVSTNSGILLISGLQSEDEADYYCMTWSSNGSGVFGGGTQLTVL      116

X355/07 VH (SEQ ID NO:393):
    1 QVQLQESGPGLVKPSETLSLTCAVYGGSFSGYYWSWIRQPPGKGLEWIGSIYHSGSTYYN   60
   61 PSLKSRVTISVDTSKNQFSLKLSSVTAADTAVYYCARDLYYYYGMDVWGQGTTVTVSS   118
X355/07 Vκ (SEQ ID NO:392):
    1 AIQMTQSPSSLSASVGDRVTITCRASQSISSYLNWYQQKPGKAPKLLIYAASSLQSGVPS   60
   61 RFSGSGSGTDFTLTISSLQPEDFATYYCQQSYFTPLYTFGQGTKLEIK             108

X910/12 VH (SEQ ID NO:395):
    1 EVQLVQSGAEVKKSGASVKVSCKASGYTFTDYYIHWVRQAPGQGLEWMGWINPNNGGVTF   60
   61 AQKFQGRVTMTRDTSISTAYMDLSSLRSDDTAVYFCARDIRMSGWLAPFDYWGQGTLVTV  120
  121 SS                                                           122
X910/12 Vλ (SEQ ID NO:394):
    1 QAVLTQPASLSASPGESARLTCTLPSDINVRYYNIYWYQQKPGSPPRYLLYYYSDSHKDQ   60
   61 GSGVPSRFSGSKDTSANTGILLISGLQSEDEADYYCMIWASNGSGVLGGGTQLTVL     116

X913/15 VH (SEQ ID NO:397):
    1 QVQLVESGGGVVQGGGSLRLSCAASGFTVRSNYMSWVRQAPGKGLEWVSAISGSGDSTYY   60
   61 ADSVKGRFTISRDNSKNTLYLQMNSLRAEDTAVYYCAKVAVTTGWYFDLWGRGTLVTVSS  120
X913/15 Vλ (SEQ ID NO:396):
    1 QAVLTQPASLSASPGESARLTCTLPSDINVRYHNIYWYQEKPGSPPRYLLYYYSDSSKGQ   60
   61 GSGVPSRFSGSKDVSTNTGILVISGLQSEDEAEYYCMTWSSNGSGVFGGGTQLTVL     116
```

FIGURE 40
(a)
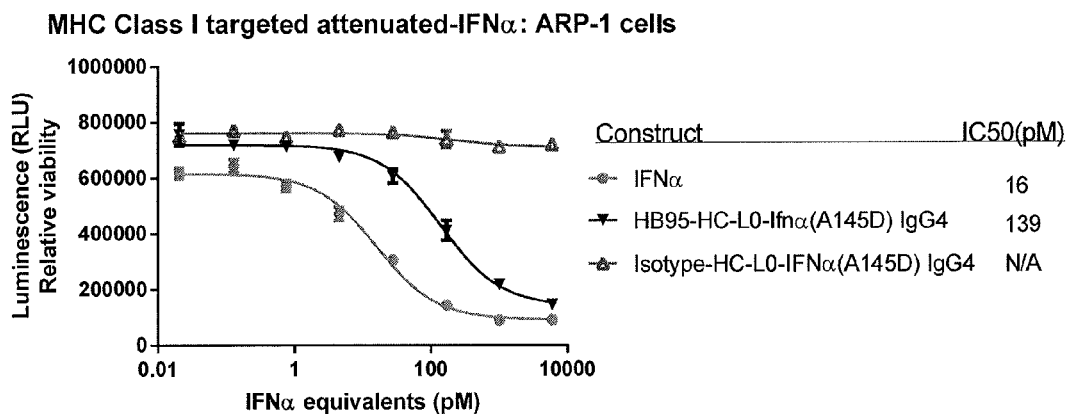
(b)
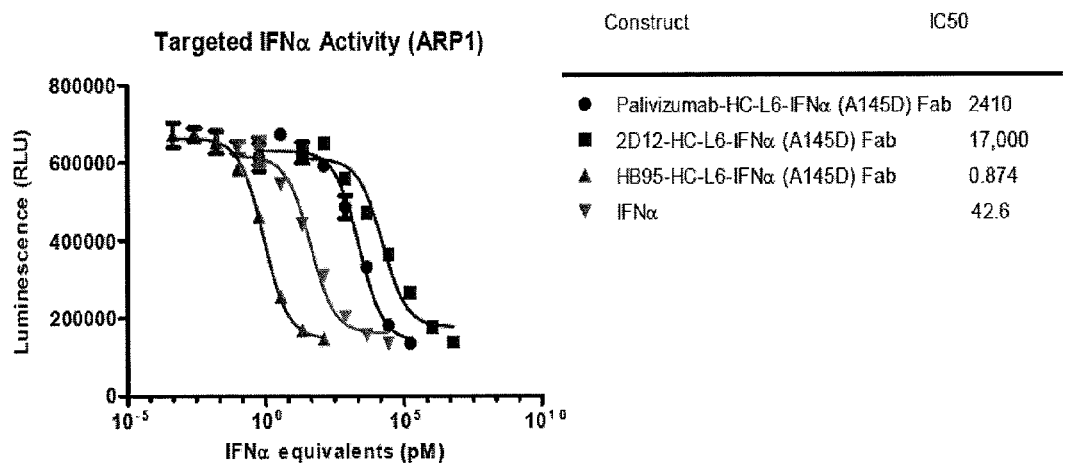

FUSIONS OF ANTIBODIES TO CD38 AND ATTENUATED INTERFERON ALPHA

RELATED APPLICATIONS

This application is a continuation of International Patent Application No. PCT/AU2012/001323, filed on Oct. 29, 2012, which claims priority to Australian Patent Application No. 2011904502, filed on Oct. 28, 2011, the contents of each application are incorporated herein by reference in their entirety and for all purposes.

REFERENCE TO A SEQUENCE LISTING

This application includes a Sequence Listing submitted electronically as a text file named Pctau2012001323-seql.txt, created on Apr. 24, 2014, with a size of 1 megabyte. The Sequence Listing is incorporated by reference herein.

FIELD OF THE INVENTION

The present invention relates to polypeptide constructs comprising mutated, attenuated polypeptide ligands attached to antibodies, wherein the antibodies direct the mutated ligands to cells that express on their surfaces the antigens to which said antibodies bind, as well as receptors for said ligands. The invention further relates to methods of treatment involving the use of these polypeptide constructs.

BACKGROUND OF THE INVENTION

Numerous peptide and polypeptide ligands have been described to function by interacting with a receptor on a cell surface, and thereby stimulating, inhibiting, or otherwise modulating a biological response, usually involving signal transduction pathways inside the cell that bears the said receptor. Examples of such ligands include peptide and polypeptide hormones, cytokines, chemokines, growth factors, apoptosis-inducing factors and the like. Natural ligands can be either soluble or can be attached to the surface of another cell.

Due to the biological activity of such ligands, some have potential use as therapeutics. Several peptide or polypeptide ligands have been approved by regulatory agencies as therapeutic products, including, for example, human growth hormone, insulin, interferon (IFN)-α2b, IFNα2a, IFNβ, erythropoietin, G-CSF and GM-CSF. Many of these and other ligands have demonstrated potential in therapeutic applications, but have also exhibited toxicity when administered to human patients. One reason for toxicity is that most of these ligands trigger receptors on a variety of cells, including cells other than those that mediate the therapeutic effect. For example, when IFNα2b is used to treat multiple myeloma its utility resides, at least in part, in its binding to type I interferon receptors on the myeloma cells, which in turn triggers reduced proliferation and hence limits disease progression. Unfortunately, however, this IFN also binds to numerous other, normal cells within the body, triggering a variety of other cellular responses, some of which are harmful (e.g. flu-like symptoms, neutropenia, depression). A consequence of such "off target" activity of ligands is that many ligands are not suitable as drug candidates. In this context, "off target activity" refers to activity on the ligand's natural receptor, but on the surface of cells other than those that mediate therapeutically beneficial effects.

Even though some ligands, such as IFNα2b, are approved for the treatment of medical conditions, they are poorly tolerated due to their "off target" biological activity. The off-target activity and associated poor tolerability also mean that some of these peptide ligand-based drugs cannot be administered at sufficiently high dosages to produce optimal therapeutic effects on the target cells which mediate the therapeutic effect.

Similarly, it has been known since the mid-1980's that interferons, in particular IFNα, are able to increase apoptosis and decrease proliferation of certain cancer cells. These biological activities are mediated by type I interferon receptors on the surface of the cancer cells which, when stimulated, initiate various signal transduction pathways leading to reduced proliferation and/or the induction of terminal differentiation or apoptosis. IFNα has been approved by the FDA for the treatment of several cancers including melanoma, renal cell carcinoma, B cell lymphoma, multiple myeloma, chronic myelogenous leukemia (CML) and hairy cell leukemia. A "direct" effect of IFNα on the tumour cells is mediated by the IFNα binding directly to the type I IFN receptor on those cells and stimulating apoptosis, terminal differentiation or reduced proliferation. One "indirect" effect of IFNα on non-cancer cells is to stimulate the immune system, which may produce an additional anti-cancer effect by causing the immune system to reject the tumour.

Unfortunately, the type I interferon receptor is also present on most non-cancerous cells. Activation of this receptor on such cells by IFNα causes the expression of numerous pro-inflammatory cytokines and chemokines, leading to toxicity. Such toxicity prevents the dosing of IFNα to a subject at levels that exert the maximum anti-proliferative and pro-apoptotic activity on the cancer cells.

Ozzello et al. (Breast Cancer Research and Treatment 25:265-76, 1993) described covalently attaching human IFNα to a tumour-targeting antibody, thereby localizing the direct inhibitory activity of IFNα to the tumour as a way of reducing tumour growth rates, and demonstrated that such conjugates have anti-tumour activity in a xenograft model of a human cancer. The mechanism of the observed anti-cancer activity was attributed to a direct effect of IFNα on the cancer cells, since the human IFNα used in the experiments did not interact appreciably with the murine type I IFN receptor, which could have lead to an indirect anti-cancer effect. Because of this lack of binding of the human IFNα to the murine cells, however, the authors could not evaluate the toxicity of the antibody-IFNα conjugate relative to free INFα. These authors used a chemical method to attach the IFNα to the antibody.

Alkan et al., (Journal of Interferon Research, volume 4, number 3, p. 355-63, 1984) demonstrated that attaching human IFNα to an antibody that binds to the Epstein-Barr virus (EBV) membrane antigen (MA) increased its antiproliferative activities towards cells that express the EBV-MA antigen. This increased potency was dependent on both antigen expression by the target cells and the binding specificity of the antibody. The cell line tested was the cancer cell line QIMR-WIL, a myeloblastic leukemia. The authors suggested that the attachment of IFNα to an antibody could be used as a treatment for cancer since it would reduce tumour growth. Alkan et al did not address the potential toxicity of these antibody-IFNα conjugates arising from their interactions with normal, antigen-negative cells.

It is also known that the linkage between an antibody and IFNα may be accomplished by making a fusion protein construct. For example, IDEC (WO01/97844) disclose a direct fusion of human IFNα to the C terminus of the heavy chain of an IgG targeting the tumour antigen CD20. Other groups have disclosed the use of various linkers between the C-terminus of an IgG heavy chain and the IFNα. For example, U.S. Pat. No. 7,456,257 discloses that the C-terminus of an antibody heavy chain constant region may be connected to IFNα via an intervening serine-glycine rich (S/G) linker of the sequence (GGGGS)$_n$, where n may be 1, 2 or 3, and that there are no significant differences in the IFNα activity of the fusion protein construct regardless of linker length.

Morrison et al. (US2011/0104112 A1; and Xuan C, Steward K K, Timmerman J M, Morrison S L. Targeted delivery of interferon-α via fusion to anti-CD20 results in potent antitumor activity against B-cell lymphoma. Blood 2010; 115:2864-71) also disclose IFNα linked to the C-terminus of the heavy chain of a cancer-targeting IgG antibody, with an intervening S/G linker, and observed that the fusion of the IgG and linker to the IFNα reduced the activity of IFNα on cells that did not express the corresponding antigen on the cell surface. The decreased IFN activity of these fusion protein constructs was modest when compared to human non-fusion protein IFNα (free IFNα) acting on human cells, but appeared to be more significant for murine IFNα on murine cells. The decrease in the activity of human IFNα that results from fusing it to the C-terminus of an antibody, as observed by Morrison et al, and in U.S. Pat. No. 7,456, 257 is modest and is generally considered to be a disadvantage since it reduces potency of the ligand. This disadvantage was pointed out, for example, by Rossi et al (Blood vol. 114, No. 18, pp 3864-71), who used an alternative strategy of attaching the IFNα to a tumor targeting antibody in such a way that no loss in IFNα activity was observed.

In general the prior art teaches to use a potent IFN and to target this IFN to cancer cells. While this approach results in an increase in activity of the IFN against cancer cells, it does not address the issue of activity of the IFN on normal "off-target" cells. In prior art examples referred to above, the human IFNα portion of the antibody-IFNα fusion protein maintained a high proportion of native IFNα activity when exposed to human cells that do not express the corresponding antigen on their cell surfaces. This activity may lead to toxicity arising from the activation of non-cancerous, normal ("off target") cells by the IFNα portion of the fusion protein. Accordingly, there exists a need to decrease the "off-target" activity of ligand-based drugs, while retaining the "on-target", therapeutic effect of such ligands. The maintenance of target-specific ligand activity and at the same time a reduction in non-target toxicity of ligand-based therapeutic agents would create a greater therapeutic concentration window for therapeutically useful ligands. It would for example be desirable to use human IFNα in a form such that its activity can be directed to the cancer cells while minimizing its effects on normal human cells. Ideally the type I interferon receptor on the cancer cells would be maximally stimulated, while the same receptor on non-cancerous cells would experience minimal stimulation. There is a need to target human IFNα to the cancer cells in such a way that it has dramatically more activity on the cancer cells, which display the antigen, than on the normal cells, which do not display the antigen. The same logic applies to other potentially therapeutic ligands, e.g. other cytokines, peptide and polypeptide hormones, chemokines, growth factors, apoptosis-inducing factors and the like.

SUMMARY OF THE INVENTION

The present inventors have found that when a peptide or polypeptide signaling ligand, having one or more mutations which substantially decrease the affinity of the ligand for its receptor, is linked to an antibody that targets the mutated ligand to target cells which display the antibody's corresponding antigen, the ligand's activity on target antigen-positive cells is maintained while the ligand's activity on non-target antigen-negative cells is substantially reduced. The net result is a ligand signaling molecule that has a much greater potency in activation of its receptors on antigen-positive target cells compared to antigen-negative non-target cells, which provides a means for reducing toxicity arising from off-target ligand activity.

Accordingly, a first aspect of the present invention provides a polypeptide construct comprising a peptide or polypeptide signaling ligand linked to an antibody or antigen binding portion thereof which binds to a cell surface-associated antigen, wherein the ligand comprises at least one amino acid substitution or deletion which reduces its potency on cells lacking expression of said antigen.

In a second aspect, the present invention provides a method of treating a tumour in a subject, comprising administering to the subject the polypeptide construct of the present invention.

In a third aspect, the present invention provides use of the polypeptide construct of the present invention in the treatment of cancer.

In a fourth aspect, the present invention provides a composition comprising the polypeptide construct of the present invention and a pharmaceutically acceptable carrier or diluent.

In a fifth aspect, the present invention provides method of reducing the potency of a peptide or polypeptide signaling ligand on an antigen negative cell which bears the ligand receptor whilst maintaining the potency of the ligand on an antigen positive cell which bears the ligand receptor to a greater extent when compared to the antigen negative cell, the method comprising modifying the ligand such that the ligand comprises at least one amino acid substitution or deletion which reduces its potency on the antigen negative cell and linking the modified ligand to an antibody or antigen-binding portion thereof, wherein the antibody or antigen binding portion thereof is specific for a cell surface-associated antigen on the antigen positive cell but not on the antigen negative cell.

Unlike the linking of a non-attenuated "native" or "wild-type" human ligand to an antibody or antigen-binding portion thereof, which typically results in from 1 to 15-fold higher potency of the ligand on antigen-positive compared to antigen-negative cells, the present invention demonstrates that the attachment of mutated, attenuated forms of the ligand to the same antibody is able to generate higher potency on antigen-positive cells compared to antigen negative cells.

In one embodiment the signaling ligand is IFNα or IFNβ and the polypeptide construct shows at least 10, at least 100, at least 1,000, at least 10,000 or at least 100,000-fold greater selectivity towards antigen positive cells over antigen negative cells compared to free, wild-type ligand using the "off-target" assay and the "on target (ARP)" or "on target (Daudi)" assays described herein.

The present invention also provides an antibody-attenuated ligand fusion proteins, wherein the attenuated ligand is IFNα or IFNβ and the wherein fusion protein construct, when injected into a mouse with an established human tumor, can eliminate the tumor.

The present invention also provides an antibody-attenuated ligand fusion proteins, wherein the attenuated ligand is IFNα or IFNβ and wherein the fusion protein construct, when injected into a mouse with an established human tumor with a volume of over 500 cubic millimeters, can eliminate the tumor.

The present invention also provides an antibody-attenuated ligand fusion proteins, wherein the attenuated ligand is IFNα or IFNβ and wherein the fusion protein construct, when injected as a single one-time treatment into a mouse with an established human tumor, can eliminate the tumor.

An antibody-attenuated ligand fusion proteins, wherein the attenuated ligand is IFNα or IFNβ and wherein the fusion protein construct can eliminate both established myeloma tumors and established lymphoma tumors in a mouse In each of these cases it is preferred that cell surface-associated antigen is CD 38.

In one embodiment, the amino acid sequence of the signaling ligand comprising at least one amino acid substitution or deletion has greater than 90% or greater than 95%, or greater than 96%, or greater than 97%, or greater than 98% or greater than 99% sequence identity with the wild-type ligand amino acid sequence.

In one embodiment, the construct is a fusion protein.

In certain embodiments the signaling ligand is linked to the C-terminus of the heavy chain of the antibody or antigen binding portion thereof. In certain embodiments the signaling ligand is linked to the C-terminus of the light chain of the antibody or antigen binding portion thereof. In either of these embodiments, the ligand may be linked directly to the C-terminus of the heavy or light chain of the antibody or antigen binding portion thereof (ie without an intervening additional linker).

In one embodiment the cell surface associated antigen is selected from class I MHC or PD-1.

In certain embodiments, the cell surface-associated antigen is a myeloma associated antigen which is selected from the group consisting of CD38, HM1.24, CD56, CS1, CD138, CD74, IL-6R, Blys (BAFF), BCMA, HLA-SR, Kininogen, beta2 microglobulin, FGFR3, ICAM-1, matriptase, CD52, EGFR, GM2, alpha-4-integrin, IFG-1R and KIR, and the ligand is an IFNα.

In one embodiment, the signaling ligand is selected from any one of IFNα2b, IFNβ, IL-4 or IL-6.

In certain embodiments in which the signaling ligand is an IFNα, the amino acid substitution or deletion may be at any one or more of amino acid positions R33, R144 or A145. In certain embodiments the signaling ligand is an IFNα and the substitution is selected from the group consisting of R144A (SEQ ID NO:30), R144S (SEQ ID NO:40), R144T (SEQ ID NO:41), R144Y (SEQ ID NO:43), R144I (SEQ ID NO:35), R144L (SEQ ID NO:37), A145D (SEQ ID NO:44), A145H (SEQ ID NO:47), A145Y (SEQ ID NO:58), A145K (SEQ ID NO:49), R33A+YNS (SEQ ID NO:65), R33A (SEQ ID NO:16) and R144A+YNS (SEQ ID NO:68).

In certain embodiments in which the signaling ligand is an IFNα and the cell surface associated antigen is CD38, the antibody is selected from any one of G003, G005, G024, MOR03077, MOR03079, MOR03080, MOR03100, 38SB13, 38SB18, 38SB19, 38SB30, 38SB31, 38SB39, OKT10, X355/02, X910/12, X355/07, X913/15, R5D1, R5E8, R10A2, or an antigen binding portion thereof, or an antibody with greater than 95%, greater than 96%, greater than 97%, greater than 98% or at least 99% amino acid sequence identity with any one of R5D1, R5E8 or R10A2.

In certain embodiments in which the cell surface associated antigen is CD38, the signaling ligand of the polypeptide construct is an IFNα, the treatment is for a cancer in a subject selected from multiple myeloma, a leukemia or a lymphoma. In particular embodiments the subject is also treated with a retinoid, such as all-trans retinoic acid. In certain embodiments in which the cell surface associated antigen is CD38, the tumour or cancer may be selected from multiple myeloma, non-Hodgkin's lymphoma, chronic myelogenous leukemia, chronic lymphocytic leukemia or acute myelogenous leukemia.

In embodiments in which the ligand is linked to an antibody, the antibody may be an IgG4. In particular embodiments the IgG4 comprises an S228P amino acid substitution.

In certain embodiments in which the signaling ligand of the polypeptide construct is an IFNα, the antibody or antigen binding portion thereof may bind to a cell surface associated antigen on virally infected cells. In these embodiments the cell surface associated antigen may be selected from a virally encoded protein, phosphatidylserine or a phosphatidylserine-binding protein. In embodiments in which the cell surface associated antigen is phosphatidylserine or a phosphatidylserine-binding protein the construct may be used to treat Hepatitis C.

In certain embodiments in which the signaling ligand of the polypeptide construct is IFNα or IFNβ, the cell surface associated antigen is selected from CD20, CD38, CD138 or CS1. In certain embodiments in which the ligand is IFNα or IFNβ, the tumour or cancer may be selected from multiple myeloma, melanoma, renal cell carcinoma, chronic myelogenous leukemia or hairy cell leukemia.

In a particular embodiment the construct is G005-HC-L0-IFNα (A145D) IgG4.

In certain embodiments in which the signaling ligand of the polypeptide construct is an IFNβ, the cell surface associated antigen may be a T cell, a myeloid cell or an antigen presenting cell cell surface associated protein.

In certain embodiments in which the signaling ligand of the polypeptide construct is an IFNβ, the cell surface associated antigen may be selected from the group consisting of CD3, CD4, CD8, CD24, CD38, CD44, CD69, CD71, CD83, CD86, CD96, HLA-DR, PD-1, ICOS, CD33, CD115, CD11c, CD14, CD52 and PD-1. In these embodiments, the construct may be used to treat a disease characterized by excess inflammation, such as an autoimmune disease.

In certain embodiments in which the signaling ligand of the polypeptide construct is an IFNβ, the at least one amino acid substitution or deletion is selected from the group consisting of R35A, R35T, E42K, M62I, G78S, A141Y, A142T, E149K, R152H. In these embodiments, the IFNβ may also possess a C17S or C17A substitution.

In certain embodiments the signaling ligand of the polypeptide construct is an IFNγ. In these embodiments, the cell surface associated antigen may be a tumor-associated antigen. In other embodiments, the cell surface associated antigen may be selected from the group consisting of CD14, FSP1, FAP, PDGFR alpha and PDGFR beta. In these embodiments, the construct may be used to treat a disease characterized by excess fibrosis.

In certain embodiments in which the signaling ligand of the polypeptide construct is an IFNγ, the at least one amino acid substitution or deletion is selected from the group consisting of a deletion of residues A23 and D24, an S20I substitution, an A23V substitution, a D21K substitution and a D24A substitution.

In certain embodiments in which the signaling ligand of the polypeptide construct is an IL-4, the cell surface associated antigen is selected from the group consisting of CD3, CD4, CD24, CD38, CD44, CD69, CD71, CD96, PD-1, ICOS, CD52 and PD-1.

In certain embodiments in which the signaling ligand of the polypeptide construct is an IL-6, the cell surface associated antigen is selected from the group consisting of CD3, CD4, CD24, CD38, CD44, CD69, CD71, CD96, PD-1, ICOS, CD52 and PD-1.

In certain embodiments in which the signaling ligand of the polypeptide construct is an HGF, the cell surface associated antigen is selected from the group consisting of ASGR1, ASGR2, FSP1, RTI140/Ti-alpha, HTI56 and a VEGF receptor.

In certain embodiments in which the signaling ligand of the polypeptide construct is a TGFβ, the cell surface associated antigen is selected from the group consisting of CD3, CD4, CD8, CD24, CD38, CD44, CD69, CD71, CD83, CD86, CD96, HLA-DR, PD-1, ICOS, CD33, CD115, CD11c, CD14, CD52 and PD-1.

In certain embodiments in which the signaling ligand of the polypeptide construct is an erythropoietin, the cell surface associated antigen is selected from the group consisting of CD241 the product of the RCHE gene, CD117 (c-kit), CD71 (transferrin receptor), CD36 (thrombospondin receptor), CD34, CD45RO, CD45RA, CD115, CD168, CD235, CD236, CD237, CD238, CD239 and CD240.

In certain embodiments in which the signaling ligand of the polypeptide construct is an interleukin-10 and the cell surface associated antigen is selected from the group consisting of CD11c, CD33 or CD115, CD14, FSP1, FAP, or PDGFR (alpha or beta).

In a sixth aspect there is provided anti-CD38 antibodies with variable regions designated X910/12, X913/15, X355/02, X355/07, R5D1, R5E8, or R10A2, with sequences set out as follows:

| Name | $V_H$ sequence | $V_K/V_L$ sequence |
|---|---|---|
| X910/12 | SEQ ID NO: 395 | SEQ ID NO: 394 |
| X913/15 | SEQ ID NO: 397 | SEQ ID NO: 396 |
| X355/01 | SEQ ID NO: 421 | SEQ ID NO: 420 |
| X355/02 | SEQ ID NO: 391 | SEQ ID NO: 390 |
| X355/04 | SEQ ID NO: 423 | SEQ ID NO: 422 |
| X355/07 | SEQ ID NO: 393 | SEQ ID NO: 392 |
| R5D1 | SEQ ID NO: 399 | SEQ ID NO: 398 |
| R5E8 | SEQ ID NO: 401 | SEQ ID NO: 400 |
| R10A2 | SEQ ID NO: 403 | SEQ ID NO: 402 |

From these sequences the person skilled in the field can readily identify the CDR sequences using known methods. As will be recognized by the skilled worker these CDR sequences can be used in differing framework sequences to those specified in the SEQ ID NO's specified above.

BRIEF DESCRIPTION OF THE DRAWINGS

FIG. 3 shows the amino acid sequences of the human CD38 (SEQ ID NO:131).

FIG. 4 shows the amino acid sequences of certain exemplary signaling ligands of the present invention: (a) human IFNα2b, IFNβ1, IFNβ1b and IFNγ; (b) IL-4 and IL-6.

FIG. 5 shows the amino acid sequences of certain antibody-attenuated ligand fusion proteins of the present invention: (a) G005-HC-L0-IFNα (A145D) IgG4; (b) nBT062-HC-L0-IFNα (A145D) IgG4; (c) G005-HC-L0-IFNβ (R35A) IgG4; (d) HB95-HC-L16-IL-6 (R179E) IgG1; and (e) J110-HC-L6-IL-4 (R88Q) IgG1. The nomenclature for the fusion proteins is described in the examples.

FIG. 13 shows the sequences of certain novel human CD38 antibodies disclosed herein.

FIG. 40 (a) shows the antiproliferative activity on the multiple myeloma cell line ARP-1 of IFNα2b and two antibody-IFNα fusion protein constructs with the A145D mutation in the IFN portion. The HB95 antibody binds human class I MHC (which is expressed on the ARP-1 cells) whereas the "isotype" antibody does not (it is derived from the antibody 2D12). Palivizumab, like 2D12, does not bind to the ARP-1 cells. (b) shows the same assay, comparing antibody-attenuated IFNα fusion protein constructs in which the antibody portion is a Fab fragment rather than a full size antibody. For both (a) and (b) panels, the assay is described in the examples as the "on target (ARP) assay."

DETAILED DESCRIPTION OF THE INVENTION

Figure 1:
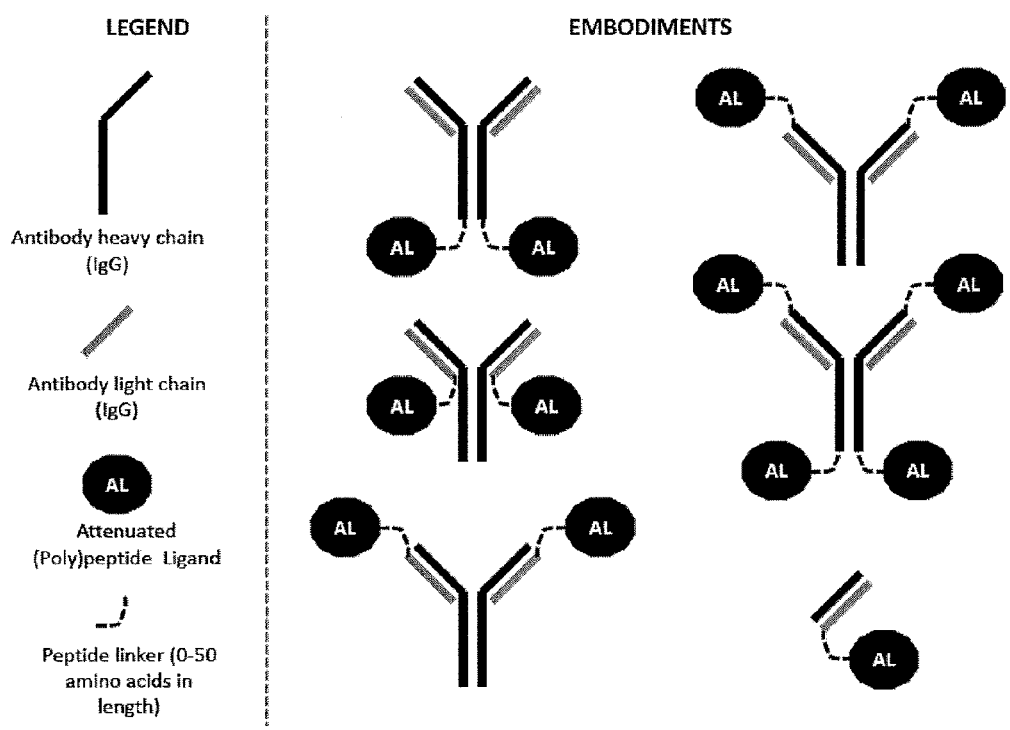
FIG. 1 shows a schematic of the certain embodiments of the present invention that comprise an antibody consisting of 2 heavy chains and 2 light chain, in which one or two attenuated signaling ligands is or are attached to each heavy chain or each light chain, or both.
Figure 2:
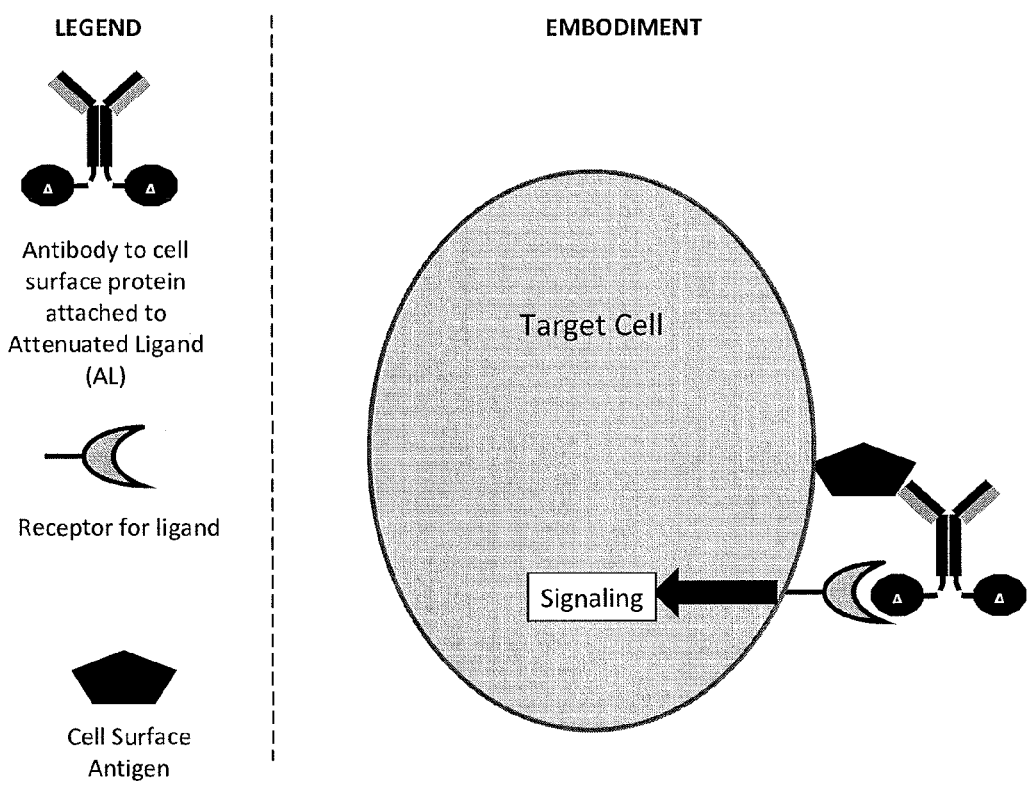
FIG. 2 shows a schematic illustrating one possible approach for how the antibody-attenuated ligand fusion proteins of the present invention cause signaling by activating receptors on cells that display the antigen corresponding to the said antibody on their cell surfaces. The fusion protein activates the receptor on the same cell that the antibody is bound to, via its specific antigen.

The constructs of the present invention are antibody-attenuated ligand constructs, which show an elevated antigen-specificity index with respect to activating signaling pathways due to the action of the attenuated ligand on a cell surface receptor. These constructs are based on the surprising discovery that, in the context of an antibody-ligand construct, the ligand portion can be mutated in such a way that the ligand activity on antigen-negative cells is dramatically attenuated, while the ligand activity on antigen-positive cells is only modestly, if at all, attenuated. Such constructs display one, two, three, four or five orders of magnitude greater potency on antigen-positive cells compared to antigen negative cells than does the free ligand. In one embodiment, the antibody-attenuated ligand construct retains at least 1%, at least 10%, at least 20%, at least 30%, at least 40% or at least 50% of the potency on antigen-positive cells as the non-attenuated free (i.e. not attached to an antibody) ligand. In addition, in one embodiment the antibody-attenuated ligand construct retains at least 30%, at least 50%, at least 75% or at least 90% of the maximal activity of the non-attenuated free (i.e. not attached to an antibody) ligand; in this context, "maximal activity" should be understood as meaning the amount of signaling activity (or downstream effect thereof) at the high, plateau portion of a dose-response curve, where further increases in the agent does not further increase the amount of response).

"Specificity" as used herein is not necessarily an absolute designation but often a relative term signifying the degree of selectivity of an antibody-ligand fusion protein construct for an antigen-positive cell compared to an antigen-negative cell. Thus for example, a construct may be said to have "100-fold specificity for antigen-positive cells compared to antigen-negative cells" and this would indicate that the construct has 100-fold higher potency on cells that express the antigen compared to cells that do not. In some cases, this degree of specificity of a construct comparing antigen-positive vs. antigen-negative cells may not be based on the absolute ratio of potency of the construct on antigen-positive vs. antigen-negative cells, but of the potency of the construct on each type of cell relative to the potency of the free, non attenuated ligand on the same same type of cell. This "ratio of ratio" approach for quantifying the degree of specificity of an antibody-ligand construct takes into consideration any inherent differences in the potency of a ligand on different cell types and is examplefied by the calculations of Antigen Specificity Index (ASI) in Table 25. Assays for determining potency of antibody-ligand fusion constructs are exemplified in the examples and include cell based assays for proliferation, apoptosis, phosphorylation of receptors and intracellular proteins, migration, differentiation (for example, differentiation of naïve CD4+ T cells into Th1, Th17, Th2 vs. Treg cells), increases or decreases in gene expression or gene product secretion into the media, etc.

Accordingly, in a first aspect the present invention provides a polypeptide construct comprising a peptide or polypeptide signaling ligand linked to an antibody or antigen binding portion thereof which binds to a cell surface-associated antigen wherein the ligand comprises at least one amino acid substitution or deletion which reduces its potency on cells lacking expression of said antigen.

In one embodiment the present invention provides a polypeptide construct comprising IFN linked to an antibody or antigen binding portion thereof which binds to a tumour associated antigen wherein the IFN comprises at least one amino acid substitution or deletion which reduces its potency on cells lacking expression of said antigen. Such a polypeptide will be capable of exerting with high potency the IFN's anti-proliferative activity on the antigen-positive tumor cells while exerting a much lower potency on the antigen-negative, non-tumour cells within the body.

In a second aspect the present invention provides a method of treating a tumour in a subject comprising administering to the subject the polypeptide construct of the present invention.

The term "antibody-ligand construct" as used herein refers to an antibody or antigen-binding fragment thereof covalently attached to a signaling ligand that has been attenuated by one or more substitutions or deletions that reduce the ligand's potency on cells that do not express the antigen corresponding to the antibody.

The term "antibody", as used herein, broadly refers to any immunoglobulin (Ig) molecule comprised of four polypeptide chains, two heavy (H) chains and two light (L) chains, or any functional fragment, mutant, variant, or derivation thereof, which retains the essential epitope binding features of an Ig molecule. Such mutant, variant, or derivative antibody formats are known in the art, non-limiting embodiments of which are discussed below.

In a full-length antibody, each heavy chain is comprised of a heavy chain variable region (abbreviated herein as HCVR or VH) and a heavy chain constant region. The heavy chain constant region is comprised of three domains, CH1, CH2 and CH3. Each light chain is comprised of a light chain variable region (abbreviated herein as LCVR or VL) and a light chain constant region. The light chain constant region is comprised of one domain, CL. The VH and VL regions can be further subdivided into regions of hypervariability, termed complementarity determining regions (CDR), interspersed with regions that are more conserved, termed framework regions (FR). Each VH and VL is composed of three CDRs and four FRs, arranged from amino-terminus to carboxy-terminus in the following order: FR1, CDR1, FR2, CDR2, FR3, CDR3, FR4. Immunoglobulin molecules can be of any type (e.g., IgG, IgE, IgM, IgD, IgA and IgY), class (e.g., IgG1, IgG2, IgG3, IgG4, IgA1 and IgA2) or subclass.

The term "antigen binding domain" or "antigen binding portion" of an antibody, as used herein, refers to one or more fragments of an antibody or protein that retain the ability to specifically bind to an antigen (e.g., CD38). It has been shown that the antigen-binding function of an antibody can be performed by fragments of a full-length antibody. Such antibody embodiments may also be bispecific, dual specific, or multi-specific formats, specifically binding to two or more different antigens. Examples of binding fragments encompassed within the term "antigen-binding portion" of an antibody include (i) a Fab fragment, a monovalent fragment consisting of the VL, VH, CL and CH1 domains; (ii) a F(ab')2 fragment, a bivalent fragment comprising two Fab fragments in addition to a portion of the hinge region, linked by a disulfide bridge at the hinge region; (iii) an Fd fragment consisting of the VH and CH1 domains; (iv) an Fv fragment consisting of the VL and VH domains of a single arm of an antibody, (v) a domain antibody (dAb) (Ward et al. 1989 Nature 341 544-6, Winter et al., PCT publication WO 90/05144 A1 herein incorporated by reference), which comprises a single variable domain; and (vi) an isolated complementarity determining region (CDR). Furthermore, although the two domains of the Fv fragment, VL and VH, are coded for by separate genes, they can be joined, using recombinant methods, by a synthetic linker that enables them to be made as a single protein chain in which the VL and VH regions pair to form monovalent molecules (known as single chain Fv (scFv); see e.g., Bird et al. 1988 Science 242 423-6; Huston et al. 1988 Proc Natl Acad Sci USA 85 5879-83). Such single chain antibodies are also intended to be encompassed within the term "antigen-binding portion" of an antibody. Other forms of single chain antibodies, such as diabodies, are also encompassed. Diabodies are bivalent, bispecific antibodies in which VH and VL domains are expressed on a single polypeptide chain, but using a linker that is too short to allow for pairing between the two domains on the same chain, thereby forcing the domains to pair with complementary domains of another chain and creating two antigen binding sites (see e.g., Holliger, P., et al., 1993, Proc. Natl. Acad. Sci. USA 90:6444-6448; Poljak, R. J., et al., 1994, Structure 2:1121-1123). Such antibody binding portions are known in the art (Kontermann and Dubel eds., Antibody Engineering 2001 Springer-Verlag. New York. 790 pp., ISBN 3-540-41354-5). In an embodiment the antibody binding portion is a Fab fragment.

The antibody described herein may be may be a humanized antibody. The term "humanized antibody" shall be understood to refer to a protein comprising a human-like variable region, which includes CDRs from an antibody from a non-human species (e.g., mouse or rat or non-human primate) grafted onto or inserted into FRs from a human antibody (this type of antibody is also referred to a "CDR-grafted antibody"). Humanized antibodies also include proteins in which one or more residues of the human protein are modified by one or more amino acid substitutions and/or one or more FR residues of the human protein are replaced by corresponding non-human residues. Humanized antibodies may also comprise residues which are found in neither the human antibody or in the non-human antibody. Any additional regions of the protein (e.g., Fc region) are generally human. Humanization can be performed using a method known in the art, e.g., U.S. Pat. No. 5,225,539, U.S. Pat. No. 6,054,297, U.S. Pat. No. 7,566,771 or U.S. Pat. No. 5,585,089. The term "humanized antibody" also encompasses a super-humanized antibody, e.g., as described in U.S. Pat. No. 7,732,578.

The antibody described herein may be human. The term "human antibody" as used herein refers to proteins having variable and, optionally, constant antibody regions found in humans, e.g. in the human germline or somatic cells or from libraries produced using such regions. The "human" antibodies can include amino acid residues not encoded by human sequences, e.g. mutations introduced by random or site directed mutations in vitro (in particular mutations which involve conservative substitutions or mutations in a small number of residues of the protein, e.g. in 1, 2, 3, 4 or 5 of the residues of the protein). These "human antibodies" do not necessarily need to be generated as a result of an immune response of a human, rather, they can be generated using recombinant means (e.g., screening a phage display library) and/or by a transgenic animal (e.g., a mouse) comprising nucleic acid encoding human antibody constant and/or variable regions and/or using guided selection (e.g., as described in or U.S. Pat. No. 5,565,332). This term also encompasses affinity matured forms of such antibodies. For the purposes of the present disclosure, a human protein will also be considered to include a protein comprising FRs from a human antibody or FRs comprising sequences from a consensus sequence of human FRs and in which one or more of the CDRs are random or semi-random, e.g., as described in U.S. Pat. No. 6,300,064 and/or U.S. Pat. No. 6,248,516.

The antibody portions of polypeptides of the present invention may be full length antibodies of any class, preferably IgG1, IgG2 or IgG4. The constant domains of such antibodies are preferably human. The variable regions of such antibodies may be of non-human origin or, preferably, be of human origin or be humanized. Antibody fragments may also be used in place of the full length antibodies.

The term "antibody" also includes engineered antibodies. As will be appreciated there are many variations of engineered antibodies (e.g. mouse monoclonal, chimeric, humanized and human monoclonal antibodies, single chain variable antibody fragments (scFv's), minibodies, aptamers, as well as bispecific antibodies and diabodies as described above).

Single variable region domains (termed dAbs) are, for example, disclosed in (Ward et al., Nature 341: 544-546, 1989; Hamers-Casterman et al., Nature 363: 446-448, 1993; Davies & Riechmann, FEBS Lett. 339: 285-290, 1994).

Minibodies are small versions of whole antibodies, which encode in a single chain the essential elements of a whole antibody. Suitably, the minibody is comprised of the VH and VL domains of a native antibody fused to the hinge region and CH3 domain of the immunoglobulin molecule as, for example, disclosed in U.S. Pat. No. 5,837,821.

In an alternate embodiment, the engineered antibody may comprise non-immunoglobulin derived, protein frameworks. For example, reference may be made to (Ku & Schutz, Proc. Natl. Acad. Sci. USA 92: 6552-6556, 1995) which discloses a four-helix bundle protein cytochrome b562 having two loops randomized to create CDRs, which have been selected for antigen binding.

There is a plethora of non-antibody recognition protein or protein domain scaffolds that may be utilised as the antigen binding domains in the constructs of this invention. These include scaffolds based on cytotoxic T lymphocyte-associated antigen 4 (CTLA-4) (Evibody; U.S. Pat. No. 7,166, 697); human transferrin (Trans-body); a three-helix bundle from the Z-domain of Protein A (Affibody); a monomeric or trimeric human C-type lectin domain (Tetranectin); the tenth human fibronectin type III domain (AdNectin); the Kunitz-type domain of human or bovine trypsin inhibitor; insect Defensin A (IICA29), APPI (Kuntiz domains); lipocalins, FABP, Bilin-binding protein, Apoloproptein D (Anticalins); human α-crystallin or ubiquitin molecule (Affilin); trypsin inhibitor II (Microbody); α2p8 or Ankyrin repeat (repeat-motif proteins), Charybdotoxin (Scorpion toxins), Min-23, Cellulose binding domain (Knottins); Neocarzinostatin, CBM4-2 and Tendamistat.

Further, in addition to scaffolds provided for by antibody-derived domains or non-antibody folds as described above, there are naturally occurring ligand binding proteins or protein domains that may be utilised as the ligand binding domains in this invention. For example, protein domains that possess ligand binding properties include extracellular domains of receptors, PDZ modules of signalling proteins, such as Ras-binding protein AF-6, adhesion molecules, and enzymes.

The present invention further encompasses chemical analogues of amino acids in the subject antibodies. The use of chemical analogues of amino acids is useful inter alia to stabilize the molecules such as if required to be administered to a subject. The analogues of the amino acids contemplated herein include, but are not limited to, modifications of side chains, incorporation of unnatural amino acids and/or their derivatives during peptide, polypeptide or protein synthesis and the use of crosslinkers and other methods which impose conformational constraints on the proteinaceous molecule or their analogues.

Examples of side chain modifications contemplated by the present invention include modifications of amino groups such as by reductive alkylation by reaction with an aldehyde followed by reduction with $NaBH_4$; amidination with methylacetimidate; acylation with acetic anhydride; carbamoylation of amino groups with cyanate; trinitrobenzylation of amino groups with 2,4,6-trinitrobenzene sulphonic acid (TNBS); acylation of amino groups with succinic anhydride and tetrahydrophthalic anhydride; and pyridoxylation of lysine with pyridoxal-5-phosphate followed by reduction with $NaBH_4$.

The guanidine group of arginine residues may be modified by the formation of heterocyclic condensation products with reagents such as 2,3-butanedione, phenylglyoxal and glyoxal.

The carboxyl group may be modified by carbodiimide activation via O-acylisourea formation followed by subsequent derivatisation, for example, to a corresponding amide.

Sulphydryl groups may be modified by methods such as carboxymethylation with iodoacetic acid or iodoacetamide; performic acid oxidation to cysteic acid; formation of a mixed disulphides with other thiol compounds; reaction with maleimide, maleic anhydride or other substituted maleimide; formation of mercurial derivatives using 4-chloromercuribenzoate, 4-chloromercuriphenylsulphonic acid, phenylmercury chloride, 2-chloromercuri-4-nitrophenol and other mercurials; carbamoylation with cyanate at alkaline pH.

Tryptophan residues may be modified by, for example, oxidation with N-bromosuccinimide or alkylation of the indole ring with 2-hydroxy-5-nitrobenzyl bromide or sulphenyl halides. Tyrosine residues on the other hand, may be altered by nitration with tetranitromethane to form a 3-nitrotyrosine derivative.

Modification of the imidazole ring of a histidine residue may be accomplished by alkylation with iodoacetic acid derivatives or N-carbethoxylation with diethylpyrocarbonate.

Examples of incorporating unnatural amino acids and derivatives during peptide synthesis include, but are not limited to, use of norleucine, 4-amino butyric acid, 4-amino-3-hydroxy-5-phenylpentanoic acid, 6-aminohexanoic acid, t-butylglycine, norvaline, phenylglycine, ornithine, sarcosine, 4-amino-3-hydroxy-6-methylheptanoic acid, 2-thienyl alanine and/or D-isomers of amino acids. A list of unnatural amino acid, contemplated herein is shown in Table 1.

TABLE 1

| Non-conventional amino acid | Code | Non-conventional amino acid | Code |
| --- | --- | --- | --- |
| α-aminobutyric acid | Abu | L-N-methylalanine | Nmala |
| α-amino-α-methylbutyrate | Mgabu | L-N-methylarginine | Nmarg |
| aminocyclopropane-carboxylate | Cpro | L-N-methylasparagine | Nmasn |
| | | L-N-methylaspartic acid | Nmasp |
| aminoisobutyric acid | Aib | L-N-methylcysteine | Nmcys |
| aminonorbornyl-carboxylate | Norb | L-N-methylglutamine | Nmgln |
| | | L-N-methylglutamic acid | Nmglu |
| cyclohexylalanine | Chexa | L-Nmethylhistidine | Nmhis |
| cyclopentylalanine | Cpen | L-N-methylisolleucine | Nmile |
| D-alanine | Dal | L-N-methylleucine | Nmleu |
| D-arginine | Darg | L-N-methyllysine | Nmlys |
| D-aspartic acid | Dasp | L-N-methylmethionine | Nmmet |
| D-cysteine | Dcys | L-N-methylnorleucine | Nmnle |
| D-glutamine | Dgln | L-N-methylnorvaline | Nmnva |
| D-glutamic acid | Dglu | L-N-methylornithine | Nmorn |
| D-histidine | Dhis | L-N-methylphenylalanine | Nmphe |
| D-isoleucine | Dile | L-N-methylproline | Nmpro |
| D-leucine | Dleu | L-N-methylserine | Nmser |
| D-lysine | Dlys | L-N-methylthreonine | Nmthr |
| D-methionine | Dmet | L-N-methyltryptophan | Nmtrp |
| D-ornithine | Dorn | L-N-methyltyrosine | Nmtyr |

TABLE 1-continued

| Non-conventional amino acid | Code | Non-conventional amino acid | Code |
| --- | --- | --- | --- |
| D-phenylalanine | Dphe | L-N-methylvaline | Nmval |
| D-proline | Dpro | L-N-methylethylglycine | Nmetg |
| D-serine | Dser | L-N-methyl-t-butylglycine | Nmtbug |
| D-threonine | Dthr | L-norleucine | Nle |
| D-tryptophan | Dtrp | L-norvaline | Nva |
| D-tyrosine | Dtyr | α-methyl-aminoisobutyrate | Maib |
| D-valine | Dval | α-methyl-γ-aminobutyrate | Mgabu |
| D-α-methylalanine | Dmala | α-methylcyclohexylalanine | Mchexa |
| D-α-methylarginine | Dmarg | α-methylcylcopentylalanine | Mcpen |
| D-α-methylasparagine | Dmasn | α-methyl-α-napthylalanine | Manap |
| D-α-methylaspartate | Dmasp | α-methylpenicillamine | Mpen |
| D-α-methylcysteine | Dmcys | N-(4-aminobutyl)glycine | Nglu |
| D-α-methylglutamine | Dmgln | N-(2-aminoethyl)glycine | Naeg |
| D-α-methylhistidine | Dmhis | N-(3-aminopropyl)glycine | Norn |
| D-α-methylisoleucine | Dmile | N-amino-α-methylbutyrate | Nmaabu |
| D-α-methylleucine | Dmleu | α-napthylalanine | Anap |
| D-α-methyllysine | Dmlys | N-benzylglycine | Nphe |
| D-α-methylmethionine | Dmmet | N-(2-carbamylethyl)glycine | Ngln |
| D-α-methylornithine | Dmorn | N-(carbamylmethyl)glycine | Nasn |
| D-α-methylphenylalanine | Dmphe | N-(2-carboxyethyl)glycine | Nglu |
| D-α-methylproline | Dmpro | N-(carboxymethyl)glycine | Nasp |
| D-α-methylserine | Dmser | N-cyclobutylglycine | Ncbut |
| D-α-methylthreonine | Dmthr | N-cycloheptylglycine | Nchep |
| D-α-methyltryptophan | Dmtrp | N-cyclohexylglycine | Nchex |
| D-α-methyltyrosine | Dmty | N-cyclodecylglycine | Ncdec |
| D-α-methylvaline | Dmval | N-cylcododecylglycine | Ncdod |
| D-N-methylalanine | Dnmala | N-cyclooctylglycine | Ncoct |
| D-N-methylarginine | Dnmarg | N-cyclopropylglycine | Ncpro |
| D-N-methylasparagine | Dnmasn | N-cycloundecylglycine | Ncund |
| D-N-methylaspartate | Dnmasp | N-(2,2-diphenylethyl)glycine | Nbhm |
| D-N-methylcysteine | Dnmcys | N-(3,3-diphenylpropyl)glycine | Nbhe |
| D-N-methylglutamine | Dnmgln | N-(3-guanidinopropyl)glycine | Narg |
| D-N-methylglutamate | Dnmglu | N-(1-hydroxyethyl)glycine | Nthr |
| D-N-methylhistidine | Dnmhis | N-(hydroxyethyl))glycine | Nser |
| D-N-methylisoleucine | Dnmile | N-(imidazolylethyl))glycine | Nhis |
| D-N-methylleucine | Dnmleu | N-(3-indolylyethyl)glycine | Nhtrp |
| D-N-methyllysine | Dnmlys | N-methyl-γ-aminobutyrate | Nmgabu |
| N-methylcyclohexylalanine | Nmchexa | D-N-methylmethionine | Dnmmet |
| D-N-methylornithine | Dnmorn | N-methylcyclopentylalanine | Nmcpen |
| N-methylglycine | Nala | D-N-methylphenylalanine | Dnmphe |
| N-methylaminoisobutyrate | Nmaib | D-N-methylproline | Dnmpro |
| N-(1-methylpropyl)glycine | Nile | D-N-methylserine | Dnmser |
| N-(2-methylpropyl)glycine | Nleu | D-N-methylthreonine | Dnmthr |
| D-N-methyltryptophan | Dnmtrp | N-(1-methylethyl)glycine | Nval |
| D-N-methyltyrosine | Dnmtyr | N-methyla-napthylalanine | Nmanap |
| D-N-methylvaline | Dnmval | N-methylpenicillamine | Nmpen |
| γ-aminobutyric acid | Gabu | N-(p-hydroxyphenyl)glycine | Nhtyr |
| L-t-butylglycine | Tbug | N-(thiomethyl)glycine | Ncys |
| L-ethylglycine | Etg | penicillamine | Pen |
| L-homophenylalanine | Hphe | L-α-methylalanine | Mala |
| L-α-methylarginine | Marg | L-α-methylasparagine | Masn |
| L-α-methylaspartate | Masp | L-α-methyl-t-butylglycine | Mtbug |
| L-α-methylcysteine | Mcys | L-methylethylglycine | Metg |
| L-α-methylglutamine | Mgln | L-α-methylglutamate | Mglu |
| L-α-methylhistidine | Mhis | L-α-methylhomophenylalanine | Mhphe |
| L-α-methylisoleucine | Mile | N-(2-methylthioethyl)glycine | Nmet |
| L-α-methylleucine | Mleu | L-α-methyllysine | Mlys |
| L-α-methylmethionine | Mmet | L-α-methylnorleucine | Mnle |
| L-α-methylnorvaline | Mnva | L-α-methylornithine | Morn |
| L-α-methylphenylalanine | Mphe | L-α-methylproline | Mpro |
| L-α-methylserine | Mser | L-α-methylthreonine | Mthr |
| L-α-methyltryptophan | Mtrp | L-α-methyltyrosine | Mtyr |
| L-α-methylvaline | Mval | L-N-methylhomophenylalanine | Nmhphe |
| N-(N-(2,2-diphenylethyl)carbamylmethyl)glycine | Nnbhm | N-(N-(3,3-diphenylpropyl)carbamylmethyl)glycine | Nnbhe |
| 1-carboxy-1-(2,2-diphenyl-ethylamino)cyclopropane | Nmbc | | |

Crosslinkers can be used, for example, to stabilize 3D conformations, using homo-bifunctional crosslinkers such as the bifunctional imido esters having (CH2)n spacer groups with n=1 to n=6, glutaraldehyde, N-hydroxysuccinimide esters and hetero-bifunctional reagents which usually contain an amino-reactive moiety such as N-hydroxysuccinimide and another group specific-reactive moiety such as maleimido or dithio moiety (SH) or carbodiimide (COOH).

Using methods well known in the art to increase binding, by for example, affinity maturation, or to decrease immunogenicity by removing predicted MHC class II-binding motifs. The therapeutic utility of the antibodies described herein can be further enhanced by modulating their functional characteristics, such as antibody-dependent cell-mediated cytotoxicity (ADCC), complement-dependent cytotoxicity (CDC), serum half-life, biodistribution and binding to Fc receptors or the combination of any of these. This modulation can be achieved by protein-engineering, glyco-engineering or chemical methods. Depending on the therapeutic application required, it could be advantageous to either increase or decrease any of these activities.

An example of glyco-engineering used the Potelligent® method as described in Shinkawa T. et al., 2003 (J Biol Chem 278: 3466-73).

Numerous methods for affinity maturation of antibodies are known in the art. Many of these are based on the general strategy of generating panels or libraries of variant proteins by mutagenesis followed by selection and/or screening for improved affinity. Mutagenesis is often performed at the DNA level, for example by error prone PCR (Thie, Voedisch et al. 2009), by gene shuffling (Kolkman and Stemmer 2001), by use of mutagenic chemicals or irradiation, by use of 'mutator' strains with error prone replication machinery (Greener 1996) or by somatic hypermutation approaches that harness natural affinity maturation machinery (Peled, Kuang et al. 2008). Mutagenesis can also be performed at the RNA level, for example by use of Qβ replicase (Kopsidas, Roberts et al. 2006). Library-based methods allowing screening for improved variant proteins can be based on various display technologies such as phage, yeast, ribosome, bacterial or mammalian cells, and are well known in the art (Benhar 2007). Affinity maturation can be achieved by more directed/predictive methods for example by site-directed mutagenesis or gene synthesis guided by findings from 3D protein modeling (see for example Queen, Schneider et al. 1989 or U.S. Pat. No. 6,180,370 or U.S. Pat. No. 5,225,539).

Methods of increasing ADCC have been described by Ferrara, Brunker et al. 2006; Li, Sethuraman et al. 2006; Stavenhagen, Gorlatov et al. 2007; Shields, Namenuk et al. 2001; Shinkawa, Nakamura et al. 2003; and WO 2008/006554.

Methods of increasing CDC have been described by Idusogie, Wong et al. 2001; Dall'Acqua, Cook et al. 2006; Michaelsen, Aase et al. 1990; Brekke, Bremnes et al. 1993; Tan, Shopes et al. 1990; and Norderhaug, Brekke et al. 1991.

References describing methods of increasing ADCC and CDC include Natsume, In et al. 2008. The disclosure of each of these references is included herein by cross reference.

A number of methods for modulating antibody serum half-life and biodistribution are based on modifying the interaction between antibody and the neonatal Fc receptor (FcRn), a receptor with a key role in protecting IgG from catabolism, and maintaining high serum antibody concentration. Dall'Acqua et al describe substitutions in the Fc region of IgG1 that enhance binding affinity to FcRn, thereby increasing serum half-life (Dall'Acqua, Woods et al. 2002) and further demonstrate enhanced bioavailability and modulation of ADCC activity with triple substitution of M252Y/S254T/T256E (Dall'Acqua, Kiener et al. 2006). See also U.S. Pat. Nos. 6,277,375; 6,821,505; and 7,083,784. Hinton et al have described constant domain amino acid substitutions at positions 250 and 428 that confer increased in vivo half-life (Hinton, Johlfs et al. 2004). (Hinton, Xiong et al. 2006). See also U.S. Pat. No. 7,217,797. Petkova et al have described constant domain amino acid substitutions at positions 307, 380 and 434 that confer increased in vivo half-life (Petkova, Akilesh et al. 2006). See also Shields et al 2001 and WO 2000/42072. Other examples of constant domain amino acid substitutions which modulate binding to Fc receptors and subsequent function mediated by these receptors, including FcRn binding and serum half-life, are described in U.S Pat. Application Nos. 20090142340; 20090068175 and 20090092599.

The glycans linked to antibody molecules are known to influence interactions of antibody with Fc receptors and glycan receptors and thereby influence antibody activity, including serum half-life (Kaneko, Nimmerjahn et al. 2006; Jones, Papac et al. 2007; and Kanda, Yamada et al. 2007). Hence, certain glycoforms that modulate desired antibody activities can confer therapeutic advantage. Methods for generating engineered glycoforms are known in the art and include but are not limited to those described in U.S. Pat. Nos. 6,602,684; 7,326,681; 7,388,081 and WO 2008/006554.

Extension of half-life by addition of polyethylene glycol (PEG) has been widely used to extend the serum half-life of proteins, as reviewed, for example, by Fishburn 2008.

As will be recognised it is possible to make conservative amino acid substitutions within the sequences of the current invention. By "conservative substitution" is meant amino acids having similar properties. As used in this specification the following groups of amino acids are to be seen as conservative substitutions: H, R and K; D, E, N and Q; V, I and L; C and M; S, T, P, A and G; and F, Y and W.

The term "cell surface-associated antigen", as used herein, broadly refers to any antigen expressed on surfaces of cells, including infectious or foreign cells or viruses.

In certain aspects of the present invention, the polypeptide constructs or compositions of the present invention may be used to treat patients with cancer. Cancers contemplated herein include: a group of diseases and disorders that are characterized by uncontrolled cellular growth (e.g. formation of tumor) without any differentiation of those cells into specialized and different cells. Such diseases and disorders include ABL1 protooncogene, AIDS related cancers, acoustic neuroma, acute lymphocytic leukaemia, acute myeloid leukaemia, adenocystic carcinoma, adrenocortical cancer, agnogenic myeloid metaplasia, alopecia, alveolar soft-part sarcoma, anal cancer, angiosarcoma, aplastic anaemia, astrocytoma, ataxia-telangiectasia, basal cell carcinoma (skin), bladder cancer, bone cancers, bowel cancer, brain stem glioma, brain and CNS tumors, breast cancer, CNS tumors, carcinoid tumors, cervical cancer, childhood brain tumors, childhood cancer, childhood leukaemia, childhood soft tissue sarcoma, chondrosarcoma, choriocarcinoma, chronic lymphocytic leukaemia, chronic myeloid leukaemia, colorectal cancers, cutaneous T-Cell lymphoma, dermatofibrosarcoma-protuberans, desmoplastic-small-round-cell-tumor, ductal carcinoma, endocrine cancers, endometrial cancer, ependymoma, esophageal cancer, Ewing's sarcoma, extrahepatic bile duct cancer, eye cancer, eye: melanoma, retinoblastoma, fallopian tube cancer, fanconi anemia, fibrosarcoma, gall bladder cancer, gastric cancer, gastrointestinal cancers, gastrointestinal-carcinoid-tumor, genitourinary cancers, germ cell tumors, gestational-trophoblastic-disease, glioma, gynaecological cancers, hematological malignancies, hairy cell leukaemia, head and neck cancer, hepatocellular cancer, hereditary breast cancer, histiocytosis, Hodgkin's disease, human papillomavirus, hydatidiform mole, hypercalcemia, hypopharynx cancer, intraocular melanoma, islet cell cancer, Kaposi's sarcoma, kidney cancer, Langerhan's-cell-histiocytosis, laryngeal cancer, leiomyosarcoma, leukemia, Li-Fraumeni syndrome, lip cancer, liposarcoma, liver cancer, lung cancer, lymphedema, lymphoma, Hodgkin's lymphoma, non-Hodgkin's lymphoma, male breast cancer, malignant-rhabdoid-tumor-of-kidney, medulloblastoma, melanoma, merkel cell cancer, mesothelioma, metastatic cancer, mouth cancer, multiple endocrine neoplasia, mycosis fungoides, myelodysplastic syndromes, multiple myeloma, myeloproliferative disorders, nasal cancer, nasopharyngeal cancer, nephroblastoma, neuroblastoma, neurofibromatosis, nijmegen breakage syndrome, non-melanoma skin cancer, non-small-cell-lung-cancer—(NSCLC), ocular cancers, oesophageal cancer, oral cavity cancer, oropharynx cancer, osteosarcoma, ostomy ovarian cancer, pancreas cancer, paranasal cancer, parathyroid cancer, parotid gland cancer, penile cancer, peripheral-neuroectodermal-tumors, pituitary cancer, polycythemia vera, prostate cancer, rare-cancers-and-associated-disorders, renal cell carcinoma, retinoblastoma, rhabdomyosarcoma, Rothmund-Thomson syndrome, salivary gland cancer, sarcoma, schwannoma, Sezary syndrome, skin cancer, small cell lung cancer (SCLC), small intestine cancer, soft tissue sarcoma, spinal cord tumors, squamous-cell-carcinoma-(skin), stomach cancer, synovial sarcoma, testicular cancer, thymus cancer, thyroid cancer, transitional-cell-cancer-(bladder), transitional-cell-cancer-(renal-pelvis-/-ureter), trophoblastic cancer, urethral cancer, urinary system cancer, uroplakins, uterine sarcoma, uterus cancer, vaginal cancer, vulva cancer, Waldenstrom's-macroglobulinemia and Wilms' tumor. In an embodiment the tumor is selected from a group of multiple myeloma or non-hodgkin's lymphoma.

As contemplated for the treatment of cancer, the antibody portions of the constructs of the present invention may bind to tumour-associated antigens, i.e., cell surface antigens that are selectively expressed by cancer cells or over-expressed in cancer cells relative to most normal cells. There are many tumour-associated antigens (TAAs) known in the art. Non-limiting examples of TAAs include enzyme tyrosinase; melanoma antigen GM2; alphafetoprotein (AFP); carcinoembryonic antigen (CEA); Mucin 1 (MUC1); Human epidermal growth factor receptor (Her2/Neu); T-cell leukemia/lymphoma 1 (TCL1) oncoprotein. Exemplary TAAs associated with a number of different cancers are telomerase (hTERT); prostate-specific membrane antigen (PSMA); urokinase plasminogen activator and its receptor (uPA/uPAR); vascular endothelial growth factor and its receptor (VEGF/VEGFR); extracellular matrix metalloproteinase inducer (EMMPRIN/CD147); epidermal growth factor (EGFR); platelet-derived growth factor and its receptor (PDGF/PDGFR) and c-kit (CD117).

A list of other TAAs is provided in US 2010/0297076, the disclosure of which is included herein by reference. Of particular interest are cell surface antigens associated with multiple myeloma cells, including but not limited to CD38, CD138, CS1, and HM1.24. In one embodiment an antigen for antibody-attenuated ligand constructs, for example, an antibody-attenuated interferon construct, is CD38.

CD38 is a 46 kDa type II transmembrane glycoprotein. It has a short N-terminal cytoplasmic tail of 20 amino acids, a single transmembrane helix and a long extracellular domain of 256 amino acids (Bergsagel, P., Blood; 85:436, 1995 and Liu, Q., Structure, 13:1331, 2005). It is expressed on the surface of many immune cells including CD4 and CD8 positive T cells, B cells, NK cells, monocytes, plasma cells and on a significant proportion of normal bone marrow precursor cells (Malavasi, F., Hum. Immunol. 9:9, 1984). In lymphocytes, however, the expression appears to be dependent on the differentiation and activation state of the cell. Resting T and B cells are negative while immature and activated lymphocytes are predominantly positive for CD38 expression (Funaro, A., J. Immunol. 145:2390, 1990). Additional studies indicate mRNA expression in non-hemopoeitic organs such as pancreas, brain, spleen and liver (Koguma, T., Biochim. Biophys. Acta 1223:160, 1994.)

CD38 is a multifunctional ectoenzyme that is involved in transmembrane signaling and cell adhesion. It is also known as cyclic ADP ribose hydrolase because it can transform $NAD^+$ and $NADP^+$ into cADPR, ADPR and NAADP, depending on extracellular pH. These products induce $Ca^{2+}$-mobilization inside the cell which can lead to tyrosine phosphorylation and activation of the cell. CD38 is also a receptor that can interact with a ligand, CD31. Activation of receptor via CD31 leads to intracellular events including $Ca^{2+}$ mobilization, cell activation, proliferation, differentiation and migration (reviewed in Deaglio, S., Trends in Mol. Med. 14:210, 2008.)

CD38 is expressed at high levels on multiple myeloma cells, in most cases of T- and B-lineage acute lymphoblastic leukemias, some acute myelocytic leukemias, follicular center cell lymphomas and T lymphoblastic lymphomas. (Malavasi, F., J. Clin Lab Res. 22:73, 1992). More recently, CD38 expression has become a reliable prognostic marker in B-lineage chronic lymphoblastic leukemia (B-CLL) (Ibrahim, S., Blood. 98:181, 2001 and Durig, J., Leuk. Res. 25:927, 2002). Independent groups have demonstrated that B-CLL patients presenting with a $CD38^+$ clone are characterized by an unfavorable clinical course with a more advance stage of disease, poor responsiveness to chemotherapy and shorter survival time (Morabito, F., Haematologica. 87:217, 2002). The consistent and enhanced expression of CD38 on lymphoid tumors makes this an attractive target for therapeutic antibody technologies.

Preferred antigens for the development of antibody-attenuated ligand fusion protein constructs which target cancer are antigens which show selective or greater expression on the cancer cells than on most other, non-transformed cells within the body. Non-protein examples of such antigens include, sphingolipids, ganglioside GD2 (Saleh et al., 1993, J. Immunol., 151, 3390-3398), ganglioside GD3 (Shitara et al., 1993, Cancer Immunol. Immunother. 36:373-380), ganglioside GM2 (Livingston et al., 1994, J. Clin. Oncol. 12:1036-1044), ganglioside GM3 (Hoon et al., 1993, Cancer Res. 53:5244-5250) and Lewis$^x$, lewis$^y$ and lewis$^{xy}$ carbohydrate antigens that can be displayed on proteins or glycolipids. Examples of protein antigens are HER-2/neu, human papillomavirus-E6 or -E7, MUC-1; KS 1/4 pan-carcinoma antigen (Perez and Walker, 1990, J. Immunol. 142:3662-3667; Bumal, 1988, Hybridoma 7(4):407-415); ovarian carcinoma antigen CA125 (Yu et al., 1991, Cancer Res. 51(2):468-475); prostatic acid phosphate (Tailor et al., 1990, Nucl. Acids Res. 18(16):4928); prostate specific antigen (Henttu and Vihko, 1989, Biochem. Biophys. Res. Comm. 160(2):903-910; Israeli et al., 1993, Cancer Res. 53:227-230); melanoma-associated antigen p97 (Estin et al., 1989, J. Natl. Cancer Instit. 81(6):445-446); melanoma antigen gp75 (Vijayasardahl et al., 1990, J. Exp. Med. 171(4):1375-1380); prostate specific membrane antigen; carcinoembryonic antigen (CEA) (Foon et al., 1994, Proc. Am. Soc. Clin. Oncol. 13:294), MUC16 (antibodies include MJ-170, MJ-171, MJ-172 and MJ-173 [U.S. Pat. No. 7,202,346], 3A5 [U.S. Pat. No. 7,723,485]). NMB (U.S. Pat. No. 8,039,593), malignant human lymphocyte antigen-APO-1 (Bernhard et al., 1989, Science 245:301-304); high molecular weight melanoma antigen (HMW-MAA) (Natali et al., 1987, Cancer 59:55-63; Mittelman et al., 1990, J. Clin. Invest. 86:2136-2144); Burkitt's lymphoma antigen-38.13; CD19 (Ghetie et al., 1994, Blood 83:1329-1336); human B-lymphoma antigen-CD20 (Reff et al., 1994, Blood 83:435-445); GICA 19-9 (Herlyn et al., 1982, J. Clin.

Immunol. 2:135), CTA-1 and LEA; CD33 (Sgouros et al., 1993, J. Nucl. Med. 34:422-430); oncofetal antigens such as alphafetoprotein for liver cancer or bladder tumor oncofetal antigen (Hellstrom et al., 1985, Cancer. Res. 45:2210-2188); differentiation antigens such as human lung carcinoma antigen L6 or L20 (Hellstrom et al., 1986, Cancer Res. 46:3917-3923); antigens of fibrosarcoma; human leukemia T cell antigen-Gp37 (Bhattacharya-Chatterjee et al., 1988, J. Immunol. 141:1398-1403); tumor-specific transplantation type of cell-surface antigen (TSTA) such as virally-induced tumor antigens including T-antigen, DNA tumor virus and envelope antigens of RNA tumor viruses; neoglycoproteins, breast cancer antigens such as EGFR (Epidermal growth factor receptor), polymorphic epithelial mucin (PEM) (Hilkens et al., 1992, Trends in Bio. Chem. Sci. 17:359); polymorphic epithelial mucin antigen; human milk fat globule antigen; colorectal tumor-associated antigens such as TAG-72 (Yokata et al., 1992, Cancer Res. 52:3402-3408), CO 17-1A (Ragnhammar et al., 1993, Int. J. Cancer 53:751-758); differentiation antigens (Feizi, 1985, Nature 314:53-57) such as I(Ma) found in gastric adenocarcinomas, SSEA-1 found in myeloid cells, VEP8, VEP9, Myl, VIM-D5, M18 and M39 found in breast epithelial cancers, $D_{156-22}$ found in colorectal cancer, TRA-1-85 (blood group H), C14 found in colonic adenocarcinoma, F3 found in lung adenocarcinoma, AH6 found in gastric cancer, Y hapten found in embryonal carcinoma cells, TL5 (blood group A), E1 series (blood group B) antigens found in pancreatic cancer, FC10.2 found in embryonal carcinoma cells, gastric adenocarcinoma antigen, CO-514 (blood group $Le^a$) found in adenocarcinoma, NS-10 found in adenocarcinomas, CO-43 (blood group $Le^b$), G49 found in A431 cells, 19.9 found in colon cancer; gastric cancer mucins; $R_{24}$ found in melanoma, MH2 (blood group $ALe^b/Le^y$) found in colonic adenocarcinoma, 4.2, D1.1, OFA-1, $G_{M2}$, OFA-2 and M1:22:25:8 found in embryonal carcinoma cells and SSEA-3 and SSEA-4. HMW-MAA (SEQ ID NO:433), also known as melanoma chondroitin sulfate proteoglycan, is a membrane-bound protein of 2322 residues which is overexpressed on over 90% of the surgically removed benign nevi and melanoma lesions (Camploi, et. al, Crit. Rev Immunol.; 24:267, 2004). Accordingly it may be a potential target cell surface associated antigen.

Other example cancer antigens for targeting with fusion protein constructs of the present invention include (exemplary cancers are shown in parentheses): CD5 (T-cell leukemia/lymphoma), CA15-3 (carcinomas), CA19-9 (carcinomas), L6 (carcinomas), CA 242 (colorectal), placental alkaline phosphatase (carcinomas), prostatic acid phosphatase (prostate), MAGE-1 (carcinomas), MAGE-2 (carcinomas), MAGE-3 (carcinomas), MAGE-4 (carcinomas), transferrin receptor (carcinomas), p97 (melanoma), MUC1 (breast cancer), MART1 (melanoma), CD20 (non Hodgkin's lymphoma), CD52 (leukemia), CD33 (leukemia), human chorionic gonadotropin (carcinoma), CD38 (multiple myeloma), CD21 (B-cell lymphoma), CD22 (lymphoma), CD25 (B-cell Lymphoma), CD37 (B-cell lymphoma), CD45 (acute myeloblastic leukemia), HLA-DR (B-cell lymphoma), IL-2 receptor (T-cell leukemia and lymphomas), CD40 (lymphoma), various mucins (carcinomas), P21 (carcinomas), MPG (melanoma), Ep-CAM (Epithelial Tumors), Folate-receptor alpha (Ovarian), A33 (Colorectal), G250 (renal), Ferritin (Hodgkin lymphoma), de2-7 EGFR (glioblastoma, breast, and lung), Fibroblast activation protein (epithelial) and tenascin metalloproteinases (glioblastoma). Some specific, useful antibodies include, but are not limited to, BR64 (Trail et al., 1997, Cancer Research 57:100 105), BR96 mAb (Trail et al., 1993, Science 261:212-215), mAbs against the CD40 antigen, such as S2C6 mAb (Francisco et al., 2000, Cancer Res. 60:3225-3231) or other anti-CD40 antibodies, such as those disclosed in U.S Patent Publication Nos. 2003-0211100 and 2002-0142358; mAbs against the CD30 antigen, such as AC10 (Bowen et al., 1993, J. Immunol. 151:5896-5906; Wahl et al., 2002 Cancer Res. 62(13): 3736-42) or MDX-0060 (U.S. Patent Publication No. 2004-0006215) and mAbs against the CD70 antigen, such as 1F6 mAb and 2F2 mAb (see, e.g., U.S. Patent Publication No. 2006-0083736) or antibodies 2H5, 10B4, 8B5, 18E7, 69A7 (U.S. Pat. No. 8,124,738). Other antibodies have been reviewed elsewhere (Franke et al., 2000, Cancer Biother. Radiopharm. 15:459 76; Murray, 2000, Semin. Oncol. 27:64 70; Breitling, F., and Dubel, S., Recombinant Antibodies, John Wiley, and Sons, New York, 1998).

In certain embodiments, useful antibodies can bind to a receptor or a complex of receptors expressed on a target cell. The receptor or receptor complex can comprise an immunoglobulin gene superfamily member, a major histocompatibility protein, a cytokine receptor, a TNF receptor superfamily member, a chemokine receptor, an integrin, a lectin, a complement control protein, a growth factor receptor, a hormone receptor or a neuro-transmitter receptor. Non-limiting examples of appropriate immunoglobulin superfamily members are CD2, CD3, CD4, CD8, CD19, CD22, CD79, CD90, CD152/CTLA-4, PD-1, B7-H4, B7-H3, and ICOS. Non-limiting examples of suitable TNF receptor superfamily members are TACI, BCMA, CD27, CD40, CD95/Fas, CD134/OX40, CD137/4-1BB, TNFR1, TNFR2, RANK, osteoprotegerin, APO 3, Apo2/TRAIL R1, TRAIL R2, TRAIL R3, and TRAIL R4. Non-limiting examples of suitable integrins are CD11a, CD11b, CD11c, CD18, CD29, CD41, CD49a, CD49b, CD49c, CD49d, CD49e, CD49f, CD103 and CD104. Non-limiting examples of suitable lectins are S type, C type, and I type lectin. Examples of antibodies to CEA are shown in Table 2.

TABLE 2

CEA Antibodies

| Ab Clones | Patent | Assignee | Comments |
|---|---|---|---|
| COL-1 | U.S. Pat. No. 6,417,337 | The Dow Chemical Company | Humanized |
| 806.077 | U.S. Pat. No. 6,903,203 | AstraZeneca UK Ltd. | Humanized |
| T84.66 | U.S. Pat. No. 7,776,330 | City of Hope | Humanized |

Antibodies that bind the CD22 antigen expressed on human B cells include, for example, HD6, RFB4, UV22-2, To15, 4KB128 and a humanized anti-CD22 antibody (hLL2) (see, e.g., Li et al. (1989) Cell. Immunol. 111: 85-99; Mason et al. (1987) Blood 69: 836-40; Behr et al. (1999) Clin. Cancer Res. 5: 3304s-3314s; Bonardi et al. (1993) Cancer Res. 53: 3015-3021).

Antibodies to CD33 include, for example, HuM195 (see, e.g., Kossman et al. (1999) Clin. Cancer Res. 5: 2748-2755; U.S. Pat. No. 5,693,761) and CMA-676 (see, e.g., Sievers et al., (1999) Blood 93: 3678-3684).

Illustrative anti-MUC-1 antibodies include, but are not limited to Mc5 (see, e.g., Peterson et al. (1997) Cancer Res. 57: 1103-1108; Ozzello et al. (1993) Breast Cancer Res. Treat. 25: 265-276), and hCTMO1 (see, e.g., Van H et al. (1996) Cancer Res. 56: 5179-5185).

Illustrative anti-TAG-72 antibodies include, but are not limited to CC49 (see, e.g., Pavlinkova et al. (1999) Clin.

Cancer Res. 5: 2613-2619), B72.3 (see, e.g., Divgi et al. (1994) Nucl. Med. Biol. 21: 9-15), and those disclosed in U.S. Pat. No. 5,976,531.

Illustrative anti-HM1.24 antibodies include, but are not limited to a mouse monoclonal anti-HM1.24 and a humanized anti-HM1.24 IgG1kappa antibody (see, e.g., Ono et al. (1999) Mol. Immuno. 36: 387-395).

In certain embodiments the targeting moiety comprises an anti-HER2 antibody. The erBB 2 gene, more commonly known as (Her-2/neu), is an oncogene encoding a transmembrane receptor. Several antibodies have been developed against Her-2/neu, including trastuzumab (e.g., HERCEPTIN™; Fornier et al. (1999) Oncology (Huntingt) 13: 647-58), TAB-250 (Rosenblum et al. (1999) Clin. Cancer Res. 5: 865-874), BACH-250 (Id.), TA1 (Maier et al. (1991) Cancer Res. 51: 5361-5369), and the mAbs described in U.S. Pat. Nos. 5,772,997; 5,770,195 (mAb 4D5; ATCC CRL 10463); and U.S. Pat. No. 5,677,171.

A number of antibodies have been developed that specifically bind HER2 and some are in clinical use. These include, for example, trastuzumab (e.g., HERCEPTIN™, Fornier et al. (1999) Oncology (Huntingt) 13: 647-658), TAB-250 (Rosenblum et al. (1999) Clin. Cancer Res. 5: 865-874), BACH-250 (Id.), TA1 (see, e.g., Maier et al. (1991) Cancer Res. 51: 5361-5369), and the antibodies described in U.S. Pat. Nos. 5,772,997; 5,770,195, and 5,677,171.

Other fully human anti-HER2/neu antibodies are well known to those of skill in the art. Such antibodies include, but are not limited to the C6 antibodies such as C6.5, DPL5, G98A, C6MH3-B1, B1D2, C6VLB, C6VLD, C6VLE, C6VLF, C6MH3-D7, C6MH3-D6, C6MH3-D5, C6MH3-D3, C6MH3-D2, C6MH3-D1, C6MH3-C4, C6MH3-C3, C6MH3-B9, C6MH3-B5, C6MH3-B48, C6MH3-B47, C6MH3-B46, C6MH3-B43, C6MH3-B41, C6MH3-B39, C6MH3-B34, C6MH3-B33, C6MH3-B31, C6MH3-B27, C6MH3-B25, C6MH3-B21, C6MH3-B20, C6MH3-B2, C6MH3-B16, C6MH3-B15, C6MH3-B11, C6MH3-B1, C6MH3-A3, C6MH3-A2, and C6ML3-9. These and other anti-HER2/neu antibodies are described in U.S. Pat. Nos. 6,512,097 and 5,977,322, in PCT Publication WO 97/00271, in Schier et al. (1996) J Mol Biol 255: 28-43, Schier et al. (1996) J Mol Biol 263: 551-567, and the like.

More generally, antibodies directed to various members of the epidermal growth factor receptor family are well suited for use as targeting antibodies or antigen binding portions thereof in the constructs of the present invention. Such antibodies include, but are not limited to anti-EGF-R antibodies as described in U.S. Pat. Nos. 5,844,093 and 5,558,864, and in European Patent No. 706,799A. Other illustrative anti-EGFR family antibodies include, but are not limited to antibodies such as C6.5, C6ML3-9, C6MH3-B1, C6-B1D2, F5, HER3.A5, HER3.F4, HER3.H1, HER3.H3, HER3.E12, HER3.B12, EGFR.E12, EGFR.C10, EGFR.B11, EGFR.E8, HER4.B4, HER4.G4, HER4.F4, HER4.A8, HER4.B6, HER4.D4, HER4.D7, HER4.D11, HER4.D12, HER4.E3, HER4.E7, HER4.F8 and HER4.C7 and the like (see, e.g., U.S. Patent publications US 2006/0099205 A1 and US 2004/0071696 A1 which are incorporated herein by reference).

It may be advantageous for the cell surface-associated antigen to be expressed at sufficient levels on the target cell that a sufficiently therapeutic amount of polypeptide construct is presented to ligand receptors on the target cell surface. Accordingly, in particular embodiments, the cell surface associated antigen is expressed at a density of greater than 12,600 copies per cell or greater than 15,000 copies per cell. Methods for determining copy number of a cell surface antigen are well known and readily available to a person of skill in the art, for example the method provided by Jilana (Am J Clin Pathol 118:560-566, 2002)

It may be advantageous for the cell surface-associated antigen to be expressed in a configuration on the cell surface such that the polypeptide construct is able to contact both the cell surface antigen and the ligand receptor on the target cell. Accordingly, in particular embodiments the cell surface associated antigen has an extracellular domain having a molecular weight of less than 240 kD.

It may be advantageous for the antibody or antigen-binding portion thereof to bind to the cell surface associated antigen with sufficient affinity to facilitate ligand binding to the ligand receptor on the cell surface. Accordingly, in particular embodiments of the present invention the polypeptide constructs exhibit an antigen binding affinity, as measured by EC50, of from 50 nM, from 25 nM, from 10 nM or from 5 nM to 0.1 pM.

As described in U.S. Pat. Nos. 6,512,097 and 5,977,322, other anti-EGFR family member antibodies can readily be produced by shuffling light and/or heavy chains followed by one or more rounds of affinity selection. Thus in certain embodiments, this invention contemplates the use of one, two, or three CDRs in the VL and/or VH region that are CDRs described in the above-identified antibodies and/or the above identified publications.

In various embodiments the targeting antibody or antigen binding portion thereof comprises an antibody or antigen binding portion thereof that specifically or preferentially binds CD20. Anti-CD20 antibodies are well known to those of skill and include, but are not limited to Rituximab, Ibritumomab, and Tositumomab, AME-133v (Applied Molecular Evolution), Ocrelizumab (Roche), Ofatumumab (Genmab), TRU-015 (Trubion) and IMMU-106 (Immunomedics).

WO 2010/105290 discloses an antibody designated "SC104" together with a range of humanised variants which bind an antigen expressed on a range of tumour cells.

In an embodiment, the antibody attachment and attenuating mutation in the ligand increases the antigen-specificity index (ASI) by greater than 10-fold, preferably greater than 50-fold, preferably greater than 100-fold, preferably greater than 1000-fold, or preferably greater than 10,000 fold. The antigen-specificity index (ASI) is defined herein as the fold increased potency in signaling activity of the polypeptide construct of the invention relative to the free non-mutated polypeptide ligand on target antigen-positive cells multiplied by the fold decreased potency in signaling activity relative to the free non-mutated polypeptide ligand on target antigen-negative cells. The term "potency" in this context may be quantitatively represented by the EC50 value, which is the mathematical midpoint of a dose-response curve, in which the dose refers to the concentration of ligand or antibody-ligand construct in an assay, and response refers to the quantitative response of the cells to the signaling activity of the ligand at a particular dose. Thus, for example, when a first compound is shown to possess an EC50 (expressed for example in Molar units) that is 10-fold lower than a second compound's EC50 on the same cells, typically when measured by the same method, the first compound is said to have a 10-fold higher potency. Conversely, when a first compound is shown to possess an EC50 that is 10-fold higher than a second compound's EC50 on the same cells, typically when measured by the same method, the first compound is said to have a 10-fold lower potency.

While the large majority of antibodies tested showed efficient targeting of attenuated IFNα the present inventors identified examples of two antigens where targeting attenuated IFNα to a target-expressing cell line did not exhibit an ASI that was appreciably greater than for the free, non-mutated ligand. The first example is demonstrated by the antigen CSPG4 (also known as HMW-MAA, high molecular weight melanoma-associated antigen). We tested two different anti-HMW-MAA-antibody-IFNα fusion protein constructs in on-target proliferation assays using A375 or CHL-1 cell lines. We did not see inhibitory activity with either cell line or antibody at the doses tested (EC50s>21 nM). The extracellular domain of this antigen is exceptionally large (extracellular domain MW approx. 240 kD-450 kD depending on glycosylation). It is possible that certain antibody-IFN fusion protein constructs that bind to very large antigens may be sterically restricted from simultaneously interacting with the IFN receptors on the same cells. It is, however, possible that other antibodies that target other epitopes of this antigen may support the targeted IFN activity. Despite this possibility it is preferred that the antibody or antigen binding portion thereof of the polypeptide construct of the present invention binds an antigen wherein the extracellular domain thereof has a molecular weight of less than 240 kD.

A second example of an antibody-attenuated IFNα fusion protein construct that did not show potent activity was based on an antibody which binds to the myeloid antigen CD33. CD33 is expressed at a relatively low level on KG-1 cells, reported as 12,600 copies per cell (Sutherland, MAbs. 1(5): 481-490, 2009). Treatment of KG-1 cells with an anti-CD33 antibody-attenuated IFNα fusion protein construct failed to inhibit proliferation at all doses tested (IC50>76 nM). We believe that the relatively low copy number of this target may in some cases, depending on other factors such as epitope position, the receptor density of the IFN receptors, etc, limit the potency of the antibody-attenuated IFN fusion protein constructs. It is, however, possible that other antibodies that target other epitopes on this antigen may support the targeted IFN activity, or that other cells with low copy numbers of CD33 may nevertheless respond to such fusion protein constructs due to higher intrinsic IFN sensitivity, for example. Despite this possibility it is preferred that the antibody or antigen binding portion thereof of the polypeptide construct of the present invention binds an antigen wherein the antigen is present on the cell at a density of greater than 12,600 copies per cell, preferably greater than 15,000 copies per cell.

Another example of an antibody-attenuated fusion protein construct in which the antibody did not provide sufficient targeting to the cancer cells was an anti-GM2 ganglioside antibody attached to an attenuated IFNα. In this case, the antibody was to a carbohydrate epitope and, as typical of such antibodies, had a low affinity (EC50 for binding target cells was ~50 nM by flow cytometry). Therefore, preferred embodiments of the present invention show high affinity binding to their antigens, with EC50s preferably below 50 nM, more preferably below 25 nM, still more preferably below 10 nM and ideally below 5 nM. In addition, preferred embodiments comprise antibodies that bind to protein and peptide epitopes rather than carbohydrate epitopes.

Multiple myeloma is of particular interest for certain embodiments of the present invention, namely fusion protein constructs comprising antibodies to multiple myeloma antigens and attenuated IFN peptides. Table 3 lists examples of multiple myeloma antigens and antibodies, with a reference to antibody sequences.

TABLE 3

| Target | Examples of Ab in preclinical or clinical development | Sequence citation | Clinical trial reference |
|---|---|---|---|
| CD40 | Dacetuzumab SGN-40 | USPTO Granted U.S. Pat. No. 7,666,422 | NCT00664898 & NCT00525447 |
| CD40 | Lucatumumab HCD-122 CHIR12.12 | USPTO#20070098718 | NCT00231166 |
| HM1.24 | XmAb5592 humanized + Fc | USPTO#20100104557 | 1999, Ozaki, Blood, 93: 3922 |
| CD56 | HuN901-DM1 BB-10901 | 1994, Roguska et al., PNAS 91: 969-973 | NCT00346255 & NCT00991562 |
| CS1 | Elotuzumab HuLuc63 | USPTO Granted U.S. Pat. No. 7,709,610 | NCT00742560 &NCT00726869 |
| CD138 | nBT062 | USPTO #20090175863 | 2008, Tassone, Blood, 104: 3688 |
| CD74 | Milatuzumab Immu-110 | Granted U.S. Pat. No. 7,312,318 | NCT00421525, Stein et. Al. 2007 and 2009 |
| IL-6R | Tocilizumab MRA | Granted U.S. Pat. No. 5,795,965 | 2007, Yoshio-Hoshino, Canc Res, 67; 871 |
| Trail-R1 | Mapatumumab, anti-DR4 | Granted U.S. Pat. No. 7,252,994 | NCT00315757 |
| Trail-R2 (DR5, APO-2) | Lexatumumab, ETR2-ST01, anti-DR5 | Granted U.S. Pat. No. 6,872,568 | 2006, Menoret, Blood, 132; 1356 |
| Baff | Belimumab LY2127399 | Granted U.S. Pat. No. 7,317,089 | |
| ICOSL | AMG-557 | USPTO application Number 20080166352 | |
| BCMA | SG1 | USPTO application Number 2012008266 | 2007, Ryan, Mol Cancer Ther, 6: 3009 |
| HLA-DR | 1D09C3 | USPTO Granted U.S. Pat. No. 7,521,047 | 2007, Carlo-Stella, Canc. Res., |
| Kininogen | C11C1 | USPTO Granted U.S. Pat. No. 4,908,431 | 2006, Sainz, Canc Immunol Immunother |

TABLE 3-continued

| Target | Examples of Ab in preclinical or clinical development | Sequence citation | Clinical trial reference |
|---|---|---|---|
| β2microglobulin | | ATCC Cat #HB-149 | 2007, Yang, Blood, 110: 3028; 2009, Clin Can Res,15: 951 |
| FGFR3 | Pro-001 | USPTO Granted U.S. Pat. No. 8,187,601 | 2006, Trudel, Blood, 2: 4908 |
| ICAM-1 | cUV3 | USPTO Granted U.S. Pat. No. 7,943,744 | 2004, Smallshaw, J Immunother; 2006, Coleman |
| Matriptase | M24-DOX | USPTO Granted U.S. Pat. No. 7,355,015 | 2010, Bertino, AACR abstract no. 2596 |
| CD20 | Rituxan and others | U.S. patent application No.: US 2010/0189729 A1 | NCT00258206 & NCT00505895 |
| CD52 | Campath-1H | USPTO Granted U.S. Pat. No. 6,569,430 | NCT00625144 |
| EGFR | Erbitux (Emma-1) | USPTO Granted U.S. Pat. No. 6,217,866 | NCT00368121 |
| GM2 | BIW-8962 | USPTO Granted U.S. Pat. No. 6,872,392 | Biowa, no ref |
| α4-integrin | natalizumab | USPTO Granted U.S. Pat. No. 5,840,299 | NCT00675428 |
| IGF-1R | CD-751, 871 figitumumab | USPTO Granted U.S. Pat. No. 7,700,742 (TBD—need to connect Ab 4.9.2 to CD751,871) | Lacy, J. Clin. Oncol, 26:3196 |
| KIR | IPH2101 | USPTO Granted U.S. Pat. No. 8,119,775 | NCT00552396; 2009, ASCO abs 09-AB-3032; |

CD38 is of particular interest as an antibody target for fusion protein constructs of the present invention. Antibodies to CD38 include for example, AT13/5 (see, e.g., Ellis et al. (1995) J. Immunol. 155: 925-937), HB7, and the like. Table 4 discloses several known CD38 antibodies that may be used in this context:

TABLE 4

| Company | Clone names | Sequence citation | Ref |
|---|---|---|---|
| Genmab/ Janssen Biotech Inc | G003. G005, G024 (Daratumumab) | WO 2006/099875 A1 | De Weers, M., J Immunol. 186: 1840, 2011 |
| MorphoSys AG | MOR03077, MORO3079, MORO3080, MORO3100 (MOR202) | U.S. 2009/0123950 A1 | |
| Sanofi-Aventis US. LLC. | 38SB13, 38SB18, 38SB19, 38SB30, 38SB31, 38SB39 (SAR650984) | U.S. 2009/0304710 A1 | |
| Tenovus UK | Chimeric OKT10 | U.S. 2010/0285004 A1 Parental hybridoma ATCC accession: CRL-8022 | Stevenson, F., Blood. 77: 1071, 1991 |
| Immunogen | HB7-Ricin | Hybridoma: ATCC HB-136 | Goldmacher, V., Blood, 84: 3017, 1994 |

The term "Signaling ligand" as used herein broadly includes any ligand involved in the activation of cell signaling pathways, including any molecule capable of activating or inhibiting cell surface receptors. The term should also be understood as including reference to molecules that can pass through the lipid bilayer of the cell membrane to activate cell signaling pathways within the cell. The term "polypeptide signaling ligand" as used herein refers to peptide and polypeptide sequences of length 6 amino acids through 1,000 amino acids in length, which bind to particular cell surface molecules ("receptors") on certain cells and thereby transmit a signal or signals within those cells. Exemplary signaling ligands and polypeptide signaling ligands contemplated by the present invention include, but are not limited to cytokines, chemokines, growth factors, hormones, neurotransmitters, and apoptosis inducing factors.

Non-limiting examples of suitable cytokines include the interleukin's IL-1, IL-2 IL-3, IL-4, IL-5, IL-6, IL-7, IL-8, IL-9, IL-10, IL-11, IL-12, IL-13, IL-14, IL-15, IL-16, IL-17, IL-18, IL-19, IL-20, IL-21, IL-22, IL-23, IL-24, IL_25, IL-26, IL-27, IL-28, IL-29, IL-30, IL-31, IL-32, IL-33, Il-35 and their subfamilies; the interferon (IFN) subfamily including Interferon type I (IFN-α (IFNA1, IFNA2, IFNA4, IFNA5, IFNA6, IFNA7, IFNA8, IFNA10, IFNA13, IFNA14, IFNA16, IFNA17, IFNA21), IFN-β (IFN-β1 (IFNB1) and IFN-β3 (IFNB3)), IFN-ω ((IFNW1), IFNWP2, IFNWP4, IFNWP5, IFNWP9, IFNWP15, IFNWP18, and IFNWP19 and IFNK), Interferon type II (IFN-γ) and Interferon type III (IFN-epsilon, -kappa, -omega, -delta, -tau, and -gamma) and interferon-like molecules (limitin, IL-28A, IL-28B, and IL-29; the IL-1 family including IL-1α, IL-1β, the IL-1 Receptor antagonist (IL-1RA) and IL1F5, IL1F6, IL1F7, IL1F8, IL1F9 and IL1F10 and the IL-17 family including IL-17A, IL-17B, IL-17C, IL-17D, IL-17E (IL-25), and IL-17F. In an embodiment the peptide or polypeptide signaling ligand is selected from the group consisting of an IFN, IL-4 and IL-6. In an embodiment the peptide or polypeptide signaling ligand is selected from the group consisting of IFNα, IFNα2b, IFNβ1, IFNβ1b and IFNγ. Preferably the sequence of IFNα is selected from SEQ ID NOs 1 to 3, 80 to 90, 434 and 435.

Exemplary chemokines include, for example, RANTES, MCAF, MIP1-alpha, IP-10, monocyte chemoattractant protein-1 (MCP-1 or CCL2), interleukin-8 (IL-8), CXCL13, XCL1 (lymphotactin-α), XCL2 (lymphotactin-β) and fractalkine (CX₃CL1).

Non-limiting examples of growth factors include, for example, Adrenomedullin (AM), Angiopoietin (Ang), Autocrine motility factor, Bone morphogenetic proteins (BMPs), Brain-derived neurotrophic factor (BDNF), Epidermal growth factor (EGF), Erythropoietin (EPO), Fibroblast growth factor (FGF), Glial cell line-derived neurotrophic factor (GDNF), Granulocyte colony-stimulating factor (G-CSF), Granulocyte macrophage colony-stimulating factor (GM-CSF), Growth differentiation factor-9 (GDF9), Hepatocyte growth factor (HGF), Hepatoma-derived growth factor (HDGF), Insulin-like growth factor (IGF), Migration-stimulating factor, Myostatin (GDF-8), Nerve growth factor (NGF) and other neurotrophins, Platelet-derived growth factor (PDGF), Thrombopoietin (TPO), Transforming growth factor alpha (TGF-α), Transforming growth factor beta (TGF-β), Tumor_necrosis_factor-alpha (TNF-α), Vascular endothelial growth factor (VEGF), placental growth factor (PlGF), IL-1-Cofactor for IL-3 and IL-6, IL-2-T-cell growth factor, IL-3, IL-4, IL-5, IL-6 and IL-7.

Exemplary apoptosis inducing factors include FasL and TRAIL.

Exemplary hormones include peptide hormones such as TRH and vasopressin, protein hormones such as insulin and growth hormone, glycoprotein hormones such as Luteinizing hormone, follicle-stimulating hormone and thyroid-stimulating hormone, Lipid and phospholipid-derived hormones such as steroid hormones e.g. testosterone and cortisol, Sterol hormones such as calcitriol, eicosanoids such as prostaglandins.

Non-limiting examples of suitable neurotransmitters include monoamines and other biogenic amines: dopamine (DA), norepinephrine (noradrenaline; NE, NA), epinephrine (adrenaline), histamine, serotonin (SE, 5-HT), somatostatin, substance P, opioid peptides and acetylcholine (ACh), The linkage between the antibody and the ligand could be made via a simple peptide bond by creating a fusion protein between the ligand and the heavy or light chain, or both, of the antibody. The ligand could be attached at either the N- or C-terminus of either the heavy or the light chain of the antibody, with or without an intervening linker peptide sequence. In an embodiment the ligand is linked to the antibody or antigen binding portion thereof via a peptide bond. In one embodiment, the ligand is linked to the C-terminus of the heavy chain of a human, humanized or chimeric IgG1, IgG2 or IgG4, either directly or with an intervening linker of 1 to 20 amino acids in length.

The mutated polypeptide ligands may be attached to the antibody or antibody fragment by means of chemical conjugation, non-covalent protein-protein interactions, or by genetic fusion. Methods for conjugating the ligands described herein with antibodies may be readily accomplished by one of ordinary skill in the art. As will be readily ascertained, commonly used chemical coupling methods may be utilized to link ligands to antibodies via for example, free amino, carboxylic acid, or sulfhydryl groups. Ligands can also be linked to antibodies via Carbonyls (—CHO); these aldehyde groups can be created by oxidizing carbohydrate groups in glycoproteins.

Some commonly used cross-linking reagents include glutaraldehyde which links protein or peptide molecules to the N-terminal or aliphatic amine groups of peptides or polypeptides, carbodiimide (EDC) which attaches proteins or peptides to the C-terminus or side chain carboxyl groups of proteins or peptides, succinimide esters (e.g. MBS, SMCC) which conjugates free amino groups and thiols from Cys residues, benzidine (BDB) which links to Tyr residues, periodate which attaches to carbohydrate groups and isothiocyanate. The use of commercial chemical conjugation kits is contemplated.

In some embodiments, labels are attached via spacer arms of various lengths to reduce potential steric hindrance. For example, a chemical linker may be used between the ligand and the antibody. Exemplary linker sequences will be readily ascertained by those of skill in the art, and are likely to include linkers such as C6, C7 and C12 amino modifiers and linkers comprising thiol groups.

The antibody-ligand fusion protein constructs of the present invention have mutations or deletions in the ligand that render the ligands less active in stimulating their receptors on cells that lack cell surface expression of the antigen to which the antibody binds.

In one aspect of the present invention, the ligand is an interferon, examples of which are type I interferons (IFN-α (alpha), IFN-β (beta), IFN-κ (kappa), IFN-δ (delta), IFN-ε (epsilon), IFN-τ (tau), IFN-ω (omega), and IFN-ζ (zeta, also known as limitin), type II interferons (IFN-γ) or type III interferons (IFN-λ1, IFN-λ2 and IFN-λ3) (Pestka, Immunological Reviews 202(1):8-32, 2004).

Type I interferons all signal through the Type I interferon receptor, which is made of of IFNAR1 and IFNAR2. Signaling occurs when a type I IFN binds IFNAR1 and IFNAR2, thus bringing them together into a complex with the IFN. This initiates a cascade of intracellular events (the "signaling") which leads, among other things, to changes in the expression of numerous interferon regulated genes. Details of the intracellular signaling events triggered by activation of the type I interferon receptor is described, for example, by Platanias, (Nature Reviews 5:375-86. 2005). Type I interferons include various interferon-alphas. Known human interferon-alphas are IFNα1b, α2α, α2β, α4b, α5, α6, α7, α8, α10, α1a/13, α14, α16, α17, αvδ, α21, α2c, and α44a. Some embodiments comprise IFN α2b, the sequence of which, SEQ ID NO:3, is shown in FIG. 4. IFNs have been approved in several forms for several indications, as outlined in Table 5 (which also shows lists of approved IFNβ and γ's):

TABLE 5

| Generic Name | Trade name | Approved for treatment |
|---|---|---|
| Interferon alpha 2a | Roferon A | Hep C, CML, Hairy cell Leukemia, NHL, Kaposi's sarcoma |
| Interferon alpha 2b | Intron A/Reliferon/ Uniferon | Hep C, Hep B, Hairy cell, melanoma, leukemia, NHL, Kaposi's sarcoma |
| Human leukocyte Interferon (HuIFN-α-Le) | Multiferon | Melanoma, viral and malignant disease |
| Interferon beta 1a, liquid | Rebif | Multiple Sclerosis |
| Interferon beta 1a, lyophylized | Avonex | Multiple Sclerosis |
| Interferon beta 1a, biogeneric (Iran) | Cinnovex | Multiple Sclerosis |
| Interferon beta 1b | Betaseron/Betaferon | Multiple Sclerosis |
| Interferon beta 1b, biosimilar (Iran) | Ziferon | Multiple Sclerosis |
| PEGylated interferon alpha 2a | Pegasys | Hepatitis B and C |
| PEGylated interferon alpha 2a (Egypt) | Reiferon Retard | Hep C, Hep B, Hairy cell, melanoma, leukemia, NHL, Kaposi's sarcoma |

TABLE 5-continued

| Generic Name | Trade name | Approved for treatment |
|---|---|---|
| PEGylated interferon alpha 2b | PegIntron | Hepatitis and melanoma |
| Generic Name | Trade name | Approved for treatment |
| PEGylated interferon alpha 2b plus ribavirin (Canada) | Pegetron | Hepatitis C |
| Interferon alfacon-1 | Infergen | Hepatitis C |
| Interferon alpha n3 | Alferon N | Genital warts |
| Interferon gamma | Actimmune | Chronic granulomatous disease |

Non-limiting examples of mutations in IFNα2b that can be used to reduce its potency are described in Tables 6 and 7, based on the sequence of human IFNα2b (SEQ ID NO:3):

TABLE 6

Relative biological activities of interferon mutants

| | relative anti-viral activity | relative anti-proliferative activity |
|---|---|---|
| IFNα2b wild type | 1 | 1 |
| L15A | 0.079 | 0.29 |
| R22A | | 0.9 |
| R23A | 0.4 | 0.49 |
| S25A | 0.76 | 0.7 |
| L26A | 0.23 | 0.21 |
| F27A | 0.58 | 0.36 |
| L30A | 0.01 | 0.0032 |
| D32A | 0.64 | 0.62 |
| R33A | 0.0015 | 0.00022 |
| H34A | 0.71 | 0.4 |
| D35A | 0.78 | 0.3 |
| Q40A | 0.97 | 0.91 |
| D114R | 0.86 | 0.46 |
| L117A | 0.14 | 0.18 |
| R120A | 0.014 | 0.0005 |
| R120E | <0.0005 | <0.0005 |
| R125A | 0.80 | 0.87 |
| R125E | 1.1 | 0.41 |
| K131A | 0.77 | 0.48 |
| E132A | 0.95 | 0.41 |
| K133A | 0.35 | 0.23 |
| R144A | 0.042 | 0.018 |
| A145G | 0.18 | 0.13 |
| M148A | 0.05 | 0.052 |
| R149A | 0.022 | 0.017 |
| S152A | 0.32 | 0.47 |
| L153A | 0.1 | 0.31 |
| N156A | 1.8 | 1.3 |
| H57Y, E58N, Q61S, L30A | 0.34 | 0.13 |
| H57Y, E58N, Q61S, R33A | 0.073 | 0.0082 |
| H57Y, E58N, Q61S, M148A | 0.45 | 0.94 |
| H57Y, E58N, Q61S, L153A | 1.06 | 2.3 |
| N65A, L80A, Y85A, Y89A | 0.012 | 0.0009 |
| N65A, L80A, Y85A, Y89A, D114A | 0.019 | 0.0005 |
| N65A, L80A, Y85A, Y89A, L117A | 0.0003 | <0.0005 |
| N65A, L80A, Y85A, Y89A, R120A | <0.00001 | <0.00001 |
| Y85A, Y89A, R120A | 0.005 | <0.0003 |
| D114A, R120A | 0.017 | 0.002 |
| L117A, R120A | 0.0015 | <0.0005 |
| L117A, R120A, K121A | 0.003 | <0.0005 |
| R120A, K121A | 0.031 | <0.0009 |
| R120E, K121E | <0.00002 | <0.0002 |
| Δ(L161-E165) | 0.72 | 1.1 |

TABLE 7

Relative affinity of interferon mutants to their receptors

| | Affinity to IFNAR1 | Affinity to IFNAR2 |
|---|---|---|
| IFNα2b wild type | 1 | 1 |
| L15A | | 0.079 |
| A19W | | 0.82 |
| R22A | | 0.73 |
| R23A | | 0.51 |
| S25A | | 0.92 |
| L26A | | 0.12 |
| F27A | | 0.22 |
| L30A | 0.46 | 0.0015 |
| L30V | | 0.0097 |
| K31A | | 0.32 |
| D32A | | 0.34 |
| R33K | | 0.00031 |
| R33A | 0.57 | 0.000087 |
| R33Q | | 0.000029 |
| H34A | | 0.37 |
| D35A | | 0.64 |
| Q40A | | 0.91 |
| D114R | | 2.5 |
| L117A | 0.45 | 0.77 |
| R120A | ND | 0.71 |
| R120E | | 1.4 |
| R125A | | 1.1 |
| R125E | | 1.1 |
| K131A | | 0.46 |
| E132A | | 1.5 |
| K133A | | 0.11 |
| K134A | | 0.75 |
| R144A | | 0.027 |
| A145G | | 0.03 |
| A145M | | 0.15 |
| M148A | | 0.02 |
| R149A | | 0.0054 |
| S152A | | 0.19 |
| L153A | | 0.083 |
| N156A | | 0.99 |
| H57Y, E58N, Q61S, L30A | 53 | 0.0011 |
| H57Y, E58N, Q61S, R33A | 40 | 0.000069 |
| H57Y, E58N, Q61S, M148A | 43 | 0.22 |
| H57Y, E58N, Q61S, L153A | 70 | 0.11 |
| N65A, L80A, Y85A, Y89A | ND | 0.53 |
| N65A, L80A, Y85A, Y89A, D114A | | 1.1 |
| N65A, L80A, Y85A, Y89A, L117A | | 1 |
| N65A, L80A, Y85A, Y89A, R120A | ND | |
| Y85A, Y89A, R120A | | 0.91 |
| D114A, R120A | | 0.83 |
| L117A, R120A | | 1.4 |
| L117A, R120A, K121A | 0.14 | 0.91 |
| R120A, K121A | | 1.7 |
| R120E, K121E | | 1.3 |
| Δ(161-165) | | 0.53 |

These mutants have known reductions in binding to the type 1 interferon receptor IFNAR1 or IFNAR2, and/or have known reductions in IFNα potency based on cell-based assays.

The data in these tables was disclosed in the following references:

Piehler, Jacob, Roisman, Laila C., Schreiber, Gideon (2000). New structural and functional aspects of the Type I interferon-receptor interaction revealed by comprehensive mutational analysis of the binding interface. *J. Biol. Chem.* 275: 40425-40433.

Jaitin, Diego A, Roisman, Laila C, Jaks, Eva, Gavutis, Martynas, Piehler, Jacob, Van der Heyden, Jose, Uze, Gilles, Schreiber, Gideon (2006). Inquiring into the differential action of interferons (IFNs): an IFN-α2 mutant with enhanced affinity to IFNAR1 is functionally similar to IFN-β. *Mol. Cell. Biol.* 26: 1888-1897.

Slutzki, Michal, Jaitin, Diego A., Yehezkel, Tuval Ben, Schreiber, Gideon (2006). Variations in the unstructured C-terminal tail of interferons contribute to differential receptor binding and biological activity. *J. Mol. Biol.* 360: 1019-1030.

Kalie, Eyal, Jaitin, Diego A., Abramovich, Renne, Schreiber, Gideon (2007). An interferon α2 mutant optimized by phage display for IFNAR1 binding confers specifically enhanced antitubor activities. *J. Biol. Chem.* 282: 11602-11611.

Pan, Manjing, Kalie, Eyal, Scaglione, Brian J., Raveche, Elizabeth S., Schreiber, Gideon, Langer, Jerome A. (2008). Mutation of to IFNAR-1 receptor binding site of human IFN-α2 generates Type I IFN competitive antagonists. Biochemistry 47: 12018-12027.

Kalie, Eyal, Jaitin, Diego A., Podoplelova, Yulia, Piehler, Jacob, Schreiber, Gideon (2008). The Stability of the ternary interferon-receptor complex rather than the affinity to the individual subunits dictates differential biological activities. J. Biol. Chem. 283: 32925-32936.

The abbreviation "YNS" is sometimes used herein to represent IFNα variants including the following mutation: H57Y, E58N and Q61S.

The present invention also contemplates combinations of the abovementioned mutations or deletions in IFNα.

The invention also contemplates the combination of the constructs of the present invention with other drugs and/or in addition to other treatment regimens or modalities such as radiation therapy or surgery. When the contructs of the present invention are used in combination with known therapeutic agents the combination may be administered either in sequence (either continuously or broken up by periods of no treatment) or concurrently or as an admixture. In the case of cancer, there are numerous known anticancer agents that may be used in this context. Treatment in combination is also contemplated to encompass the treatment with either the construct of the invention followed by a known treatment, or treatment with a known agent followed by treatment with the construct of the invention, for example, as maintenance therapy. For example, in the treatment of cancer it is contemplated that the constructs of the present invention may be administered in combination with an alkylating agent (such as mechlorethamine, cyclophosphamide, chlorambucil, ifosfamidecysplatin, or platinum-containing alkylating-like agents such as cysplatin, carboplatin and oxaliplatin), an antimetabolite (such as a purine or pyrimidine analogue or an antifolate agent, such as azathioprine and mercaptopurine), an anthracycline (such as Daunorubicin, Doxorubicin, Epirubicin Idarubicin, Valrubicin, Mitoxantrone, or anthracycline analog), a plant alkaloid (such as a vinca alkaloid or a taxane, such as Vincristine, Vinblastine, Vinorelbine, Vindesine, paclitaxel or Dosetaxel), a topoisomerase inhibitor (such as a type I or type II topoisomerase inhibitor), a Podophyllotoxin (such as etoposide or teniposide), or a tyrosine kinase inhibitor (such as imatinib mesylate, Nilotinib, or Dasatinib).

In the case of the treatment of multiple myeloma, it is contemplated that the constructs of the present invention may be administered in combination with current therapies, such as steroids such as dexamethasone, proteasome inhibitors (such as bortezomib or carfilzomib), immunomodulatory drugs (such as thalidomide, lenalidomide or pomalidomide), or induction chemotherapy followed by autologous haematopoietic stem cell transplantation, with or without other chemotherapeutic agents such as Melphalan hydrochloride or the chemotherapeutic agents listed above.

In the case of the treatment of Hodgkin's lymphoma, it is contemplated that the constructs of the present invention may be administered in combination with current therapeutic approaches, such as ABVD (Adriamycin (doxorubicin), bleomycin, vinblastine, and dacarbazine), or Stanford V (doxorubicin, bleomycin, vinblastine, vincristine, mechlorethamine, etoposide, prednisone), or BEACOPP (doxorubicin, bleomycin, vincristine, cyclophosphamide, procarbazine, etoposide, prednisone).

In the case of non-Hodgkin's lymphoma or other lymphomas, it is contemplated that the constructs of the present invention may be administered in combination current therapeutic approaches. Examples of drugs approved for non-Hodgkin lymphoma include Abitrexate (Methotrexate), Adriamycin PFS (Doxorubicin Hydrochloride), Adriamycin RDF (Doxorubicin Hydrochloride), Ambochlorin (Chlorambucil), Amboclorin (Chlorambucil), Arranon (Nelarabine), Bendamustine Hydrochloride, Bexxar (Tositumomab and Iodine I 131 Tositumomab), Blenoxane (Bleomycin), Bleomycin, Bortezomib, Chlorambucil, Clafen (Cyclophosphamide), Cyclophosphamide, Cytoxan (Cyclophosphamide), Denileukin Diftitox, DepoCyt (Liposomal Cytarabine), Doxorubicin Hydrochloride, DTIC-Dome (Dacarbazine), Folex (Methotrexate), Folex PFS (Methotrexate), Folotyn (Pralatrexate), Ibritumomab Tiuxetan, Istodax (Romidepsin), Leukeran (Chlorambucil), Linfolizin (Chlorambucil), Liposomal Cytarabine, Matulane (Procarbazine Hydrochloride), Methotrexate, Methotrexate LPF (Methotrexate), Mexate (Methotrexate), Mexate-AQ (Methotrexate), Mozobil (Plerixafor), Nelarabine, Neosar (Cyclophosphamide), Ontak (Denileukin Diftitox), Plerixafor, Pralatrexate, Rituxan (Rituximab), Rituximab, Romidepsin, Tositumomab and Iodine I 131 Tositumomab, Treanda (Bendamustine Hydrochloride), Velban (Vinblastine Sulfate), Velcade (Bortezomib), and Velsar (Vinblastine Sulfate), Vinblastine Sulfate, Vincasar PFS (Vincristine Sulfate), Vincristine Sulfate, Vorinostat, Zevalin (Ibritumomab Tiuxetan), Zolinza (Vorinostat). Examples of drug combinations used in treating non-Hodgkin lymphoma include CHOP (C=Cyclophosphamide, H=Doxorubicin Hydrochloride (Hydroxydaunomycin), O=Vincristine Sulfate (Oncovin), P=Prednisone); COPP (C=Cyclophosphamide, O=Vincristine Sulfate (Oncovin), P=Procarbazine Hydrochloride, P=Prednisone); CVP (C=Cyclophosphamide, V=Vincristine Sulfate, P=Prednisone); EPOCH (E=Etoposide, P=Prednisone, O=Vincristine Sulfate (Oncovin), C=Cyclophosphamide, H=Doxorubicin Hydrochloride (Hydroxydaunomycin)); ICE (I=Ifosfamide, C=Carboplatin, E=Etoposide) and R-CHOP (R=Rituximab, C=Cyclophosphamide, H=Doxorubicin Hydrochloride (Hydroxydaunomycin), O=Vincristine Sulfate (Oncovin), P=Prednisone.

Combination of retinoids with interferon-based fusion protein constructs is also contemplated. Retinoids are a family of molecules that play a major role in many biological functions including growth, vision, reproduction, epithelial cell differentiation and immune function (Meyskens, F. et al. Crit. Rev Oncol Hematol 3:75, 1987, Herold, M. et al. Acta Dermatovener 74:29 1975). Early preclinical studies with the retinol all-trans retinoic acid or ATRA, either alone or in combination with other agents, demonstrated activity against acute promyelocytic leukemia (APL), myelodysplastic syndrome, chronic myelogenous leukemia (CML), mycosis fungoides and multiple myeloma (reviewed in Smith, M. J. Clin. Oncol. 10:839, 1992). These studies led to the approval of ATRA for the treatment of APL. Currently there are over 100 clinical trials evaluating the activity of ATRA in combination with other therapies for the treatment of hematological malignancies, kidney cancers, lung cancers, squamous cell carcinomas and more. Of particular interest and pertaining directly to this invention are the studies demonstrating enhanced efficacy of interferon-α treatment when combined with ATRA. This is described for mantle cell lymphoma (Col, J. et al. Cancer Res. 72:1825, 2012), renal cell carcinoma (Aass, N. et al. J. Clin. Oncol. 23:4172, 2005; Motzer, R. J. Clin. Oncol. 18:2972, 2000), CML, melanoma, myeloma and renal cell carcinoma (Kast, R. Cancer Biology and Therapy, 7:1515, 2008) and breast cancer (Recchia, F. et al. J. Interferon Cytokine Res. 15:605, 1995). We would therefor predict enhanced activity of our targeted attenuated IFNs when combined with therapeutic dosing of ATRA in the clinic. In addition, Mehta (Mol Cancer Ther 3(3):345-52, 2004) demonstrated that in vitro treatment of leukemia cells with retinoic acid induced expression of CD38 antigen. Thus, the enhanced efficacy of interferon plus the induced expression of the target CD38 would indicate a combination therapy of ATRA with our anti-CD38 antibody-attenuated IFNα in the treatment of IFN-sensitive cancers that express CD38 or may be induced by ATRA to express CD38. Example of such cancers are multiple myeloma, non-Hodgekin's lymphoma, CML and AML.

In addition, while the above constructs are based on IFNα2b, the mutations or deletions could also be made in the context of any of the other IFNαs or IFNβ. In another embodiment of the present invention, the type I IFN is an IFNβ. IFN-β is approved for the treatment of multiple sclerosis (MS). IFN-β could be attenuated by mutation or deletion and then attached to an antibody that targets cells involved in the pathogenesis of this disease. IFN-β is an effective drug in MS, but its use is associated with adverse events, including injection site inflammation, flu-like symptoms, leukocytopenia, liver dysfunction and depression, leading to discontinuation in a subset of patients. By directing IFN-β activity directly to pathogenic cells, these adverse events may be avoided.

Pathogenesis of MS is thought to be initiated and progressed by a number of events, including innate activation of dendritic and microglial cells through toll-like receptors, an imbalance between pro-inflammatory and anti-inflammatory/regulatory cytokines, differentiation of CD4+ T cells into Th1 and Th17 phenotypes, activation of Th1 cells by antigen presenting cells (APCs), reduction in the number of regulatory T (Treg) cells and migration of activated immune cells across the blood-brain barrier (BBB). The primary drivers of the clinical episodes of the disease are thought to be autoreactive, myelin-specific Th1 cells (reviewed in Gandhi, 2010 J Neuroimmunol 221:7; Boppana, 2011 Mt Sinai J Med 78:207; Loma, 2011 Curr Neuropharmacol 9:409).

In an embodiment of the invention, an attenuated version of IFN-β may be attached to an antibody targeting a cell surface marker specific for T cells, for the treatment of multiple sclerosis or other autoimmune indications where IFN-β may be effective. Direct effects of IFN-β on T cells include inhibition of proliferation (Rep, 1996 J Neuroimmunol 67:111), downregulation of the co-stimulatory molecule CD40L (Teleshova, 2000 Scand J. Immunol. 51:312), decrease of metaloproteinase activity leading to reduced migration across the BBB (Stuve, 1996 Ann Neurol 40:853; Uhm, 1999 Ann Neurol 46:319), induction of apoptosis by upregulating intracellular CTLA-4 and cell surface Fas molecules (Hallal-Longo, 2007 J Interferon Cytokine Res 27:865), downregulation of anti-apoptotic proteins (Sharief, 2001 J Neuroimmunol. 120:199; Sharief, 2002 J Neuroimmunol. 129:224), and restoration of Treg function (De Andres, 2007 J Neuroimmunol 182:204; Korporal, 2008 Arch Neurol 65:1434; Sarasella, 2008 FASEB J 22:3500; Chen, 2012 J Neuroimmunol 242:39).

Therefore, in one aspect of the present invention, an attenuated IFN-β is attached to an anti-CD3 antibody that targets all T cells, which includes CD4+, CD8+, Treg, Th1, Th2 and Th17 cells. This comprehensive approach ensures full coverage of all T cells, as all of these cell types have reported roles in MS pathogenesis and are affected by IFN-β treatment (Dhib-Jalbut, 2010 Neurology 74:S17; Prinz, 2010 Trends Mol Med 16:379; Graber, 2010 Clin Neurol Neurosurg 112:58 and Loma, 2011 Curr Neuropharmacol 9:409). Examples of CD3 antibodies that may be incorporated into the fusion protein constructs of the present invention are listed in Table 8.

TABLE 8

CD3 Antibodies

| Ab Clones | Patent | Assignee | Comments |
|---|---|---|---|
| TF NSO CD3A.122 | U.S. Pat. No. 7,994,289 | BTG International | Humanized |
| M291 | U.S. Pat. No. 7,381,803 | PDL BioPharma | Humanized |
| 28F1, 27H5, 23F10, 15C3 | U.S. Pat. No. 7,728,114 | Novimmune S.A. | Human |

Alternatively, an attenuated IFN-β-anti-CD4 fusion protein construct presents a more restrictive approach, but would target autoreactive and regulatory T cells, including Th1 and Th17 cells and $CD4^+CD25^+$ Treg cells. In addition, subsets of dendritic cells (DCs) also express CD4 and direct therapeutic effects of IFN-β on DCs have been disclosed (Shinohara, 2008 Immunity 29:68; Dann, 2012 Nat Neurosci 15:98). Examples of CD4 antibodies that may be incorporated into the fusion protein constructs of the present invention are listed in Table 9.

TABLE 9

CD4 Antibodies

| Ab Clones | Patent | Assignee | Comments |
|---|---|---|---|
| CE9.1 | U.S. Pat. No. 7,452,534 | Biogen Idec | Non-human primate variable regions |
| TRX1 | U.S. Pat. No. 7,541,443 | Tolerrx | Humanized |
| 1E11, 1G2, 6G5, 10C5, 4D1 | U.S. Pat. No. 8,231,877 | GenPharm | Human |

A role for $CD8^+$ T cells in MS has been reported (Friese, 2005 Brain 128:1747; Friese, 2009 Ann Neurol 66:132), as well as a direct effect of IFN-β on CD8+ T cells in MS patients (Zafranskaya, 2006 Immunol 121:29). Therefore, directing an attenuated IFN-β directly to $CD8^+$ T cells with an anti-CD8 antibody may result in clinical benefits for MS patients. Examples of CD8 antibodies are shown in Table 10.

TABLE 10

CD8 Antibodies

| Ab Clones | Patent | Assignee | Comments |
|---|---|---|---|
| 37B1, 8G6 | U.S. Pat. No. 7,247,474 | Ortho-McNeil Pharmaceutical, Inc. | Hybridomas deposited at ATCC (HB-12441, HB-12657) |

TABLE 10-continued

CD8 Antibodies

| Ab Clones | Patent | Assignee | Comments |
|---|---|---|---|
| OKT8 | U.S. Pat. No. 4,361,550 | Ortho Pharmaceutical Corporation | Hybridoma deposited at ATCC (CRL-8014) |
| Several examples | US2009/0304659 | Baylor Research Institute | |

Markers of activated T cells, including, but not limited to CD25, CD38, CD44, CD69, CD71, CD83, CD86, CD96, HLA-DR, ICOS and PD-1, also represent attractive targets for this approach, since activated T cells are thought to be the main drivers of autoreactivity resulting in demyelination in MS (Gandhi, 2010 J Neuroimmunol 221:7; Boppana, 2011 Mt Sinai J Med 78:207; Loma, 2011 Curr Neuropharmacol 9:409). Antibodies targeting any of these antigens could be attached to an attenuated IFNβ. Examples antibodies that could be used in the present invention include the following: CD71 antibodies include BA120g (U.S. Pat. No. 7,736,647) and various antibodies mentioned in Wang et al (Di Yi Jun Yi Da Xue Xue Bao (Academic journal of the first medical college of PLA) 22(5):409-411, 2002). Examples of antibodies to CD83 include 20B08, 6G05, 20D04, 11G05, 14C12, 96G08 and 95F04 (U.S. Pat. No. 7,700,740). An example of an antibody to CD86 includes 1G10H6D10 (U.S. Pat. No. 6,071,519). HLA-DR antibodies include HD3, HD4, HD6, HD7, HD8 and HD10 (U.S. Pat. No. 7,262,278), DN1921 and DN1924 (US2005/0208048). One attractive target along these lines could be PD-1, which is expressed on recently activated T cells. Ideally, a non-antagonizing antibody could be used, such as the J110 antibody discussed in further detail below.

Examples of antibodies to ICOS include JMabs (U.S. Pat. No. 6,803,039) and JMab 136 (US2011/0243929).

Further of these examples of antibodies to these targets are shown in the Tables 11 and 12

TABLE 11

CD25 Antibodies

| Ab Clones | Patent | Assignee | Comments |
|---|---|---|---|
| 'Anti-tac' Abs | U.S. Pat. No. 5,530,101 | PDL, Inc | daclizumab |
| RFT5 | U.S. Pat. No. 6,521,230 | Novartis AG | Chimeric, inhibits MLR |
| AB1, AB7, AB11, AB12 | U.S. Pat. No. 8,182,812 (or U.S. Pat. No. 7,438,907) | Genmab A/S | Human antibodies, prevent CD25-IL-2 interaction and inhibit MLR |

TABLE 12

CD44 Antibodies

| Ab Clones | Patent | Assignee | Comments |
|---|---|---|---|
| H90 | US2007/0237761 | | Chimeric |
| 1A9, 2D1, 14G9, 10C8 | US2010/0092484 | | Human |
| SACK-1 | U.S. Pat. No. 7,816,500 | Sackstein | Binds CD44 glycoforms |

In another embodiment of the invention, an attenuated version of IFN-β can be fused to an antibody targeting cell surface markers of myeloid cells, known to contribute to MS pathogenesis by driving T cell activation and differentiation. For example, the pan-myeloid markers CD33, CD115, or the dendritic cell marker CD11c may be targeted. A broad targeting approach may be preferred, for example, using antibodies against CD33 or CD115, since the exact contribution of each of the myeloid cell subsets to MS disease pathogenesis and response to IFN-β has been disputed (Prinz, 2008 Immunity 28:675; Shinohara, 2008 Immunity 29:68; Dann, 2012 Nat Neurosci 15:98). Antibodies to CD33 that could be used in the present invention include My9-6 (U.S. Pat. No. 7,557,189), any of 14 antibodies described in US patent application US2012/0082670, or the antibody known as huM195 (U.S. Pat. No. 5,693,761). Antibodies to CD115 that could be used include Abl and Ab16 (U.S. Pat. No. 8,206,715) or CXIIG6 (US2011/0178278). An example of a CD11c antibody that could be used according to the present invention is mab 107 (U.S. Pat. No. 7,998,738, ATCC deposit number PTA-11614). The attenuated IFN-β could alternatively be directed to the CD14 antigen, present primarily on macrophages. Examples of CD14 antibodies are shown in Table 13.

TABLE 13

CD14 Antibodies

| Ab Clones | Patent | Assignee | Comments |
|---|---|---|---|
| 4C1 | U.S. Pat. No. 6,245,897 | Seikagaku Corporation | Mouse Ab |
| F1024-1-3 | U.S. Pat. No. 7,264,967 | Mochida Pharmaceutical Co. | Humanized, inhibits CD14/TLR binding |
| F1024, F1031-13-2 | U.S. Pat. No. 8,252,905/ US2008/0286290 | Mochida Pharmaceutical Co. | Part of fusion proteins with protease |

In yet another embodiment, targeting CD52-expressing cells would deliver IFN-β to all lymphocytes and, in addition, to monocytes and peripheral dendritic cells (Buggins, 2002 Blood 100:1715; Ratzinger, 2003 Blood 101:1422), which are the key APCs responsible for proliferation and differentiation of autoreactive T cells in MS. This approach would direct the activity of IFN-β to the key cell types known to be directly affected by IFN-β and would facilitate its therapeutic activity in MS. Examples of CD52 antibodies that could be used according to the present invention include, but are not limited to DIVHv5/DIVKv2 (U.S. Pat. No. 7,910,104), any of the CD52 antibodies disclosed in (US2012/0100152) or CAMPATH.

Any of the above mentioned, antibody-targeted attenuated IFNβ fusion protein constructs may have therapeutic activity in the context of other inflammatory and autoimmune diseases beyond multiple sclerosis, due to their common underlying immunological etiologies.

Autoimmune diseases contemplated herein include inter alia alopecia areata, ankylosing spondylitis, antiphospholipid syndrome, autoimmune Addison's disease multiple sclerosis, autoimmune disease of the adrenal gland, autoimmune hemolytic anemia, autoimmune hepatitis, autoimmune oophoritis and orchitis, Behcet's disease, bullous pemphigoid, cardiomyopathy, celiac sprue-dermatitis, chronic fatigue syndrome (CFIDS), chronic inflammatory demyelinating, chronic inflammatory polyneuropathy, Churg-Strauss syndrome, cicatricial pemphigoid, crest syndrome, cold agglutinin disease, Crohn's disease, irritable bowel syndrome, inflammatory bowel disease, dermatitis herpetiformis, discoid lupus, essential mixed cryoglobulinemia, fibromyalgia, glomerulonephritis, Grave's disease, Guillain-Barre, Hashimoto's thyroiditis, idiopathic pulmonary fibrosis, idiopathic thrombocytopenia purpura (ITP), IgA nephropathy, insulin dependent diabetes (Type I), lichen planus, lupus, Meniere's disease, mixed connective tissue disease, multiple sclerosis, myasthenia gravis, myocarditis, pemphigus vulgaris, pernicious anemia, polyarteritis nodosa, polychondritis, polyglancular syndromes, polymyalgia rheumatica, polymyositis and dermatomyositis, pochitis, primary agammaglobulinemia, primary biliary cirrhosis, psoriasis, Raynaud's phenomenon, Reiter's syndrome, rheumatic fever, rheumatoid arrthritis, sarcoidosis, scleroderma, Sjogren's syndrome, stiff-man syndrome, systemic lupus erythematosus, Takayasu arteritis, temporal arteritis/giant cell arteritis, ulcerative colitis, uveitis, vasculitis and vitiligo. Of particular interest is Behçet's disease and chronic uveitic macular edema and other types of uveitis, since IFNα has been shown to render therapeutic benefit (Deuter, Dev Ophthalmol. 51:90-7. 2012)

Examples of inflammatory disease conditions contemplated by the present disclosure include but are not limited to those disease and disorders which result in a response of redness, swelling, pain, and a feeling of heat in certain areas that is meant to protect tissues affected by injury or disease. Inflammatory diseases which can be treated using the methods of the present disclosure, include, without being limited to, acne, angina, arthritis, aspiration pneumonia, disease, empyema, gastroenteritis, inflammation, intestinal flu, NEC, necrotizing enterocolitis, pelvic inflammatory disease, pharyngitis, PID, pleurisy, raw throat, redness, rubor, sore throat, stomach flu and urinary tract infections, chronic inflammatory demyelinating polyneuropathy, chronic inflammatory demyelinating polyradiculoneuropathy, chronic inflammatory demyelinating polyneuropathy, chronic inflammatory demyelinating polyradiculoneuropathy.

The sequence of human interferon-β1 is shown below: (SEQ ID NO: 191)

```
                       *           *         *         *
  1  MSYNLLGFLQ RSSNFQCQKL LWQLNGRLEY CLKDRMNFDI PEEIKQLQQF   50

*         *                  *
 51  QKEDAALTIY EMLQNIFAIF RQDSSSTGWN ETIVENLLAN VYHQINHLKT  100

*                      **    * *
101  VLEEKLEKED FTRGKLMSSL HLKRYYGRIL HYLKAKEYSH CAWTIVRVEI  150

*
151  LRNFYFINRL TGYLRN                                      166
```

Using the numbering scheme above (residues 1-166), known mutations (at positions indicated by asterisks) in human IFNβ that reduce its activity include those listed in Table 14.

TABLE 14

| IFNβ activity-attenuating mutations | | |
|---|---|---|
| IFNbeta mutations | Fold attenuation* | Reference |
| wild type | 1 | |
| R27A | 3.3 | 1 |
| R35A + C17S | 280 | 3 |
| R35T | 10 | 1 |
| E42K | >10 | 2 |
| D54N | 1.4 | 2 |
| M62I | 8.7 | 2 |
| G78S | 6.2 | 2 |
| K123 | 2.5 | 1 |
| C141Y | >25 | 2 |
| A142T | >10 | 2 |
| R147A + C17S** | 1.7 | 3 |
| E149K | >5 | 2 |
| R152H | 4.7 | 2 |

*based on anti-proliferation activity

**the C17S mutation was made in order to remove the unpaired cysteine in the native sequence of IFNβ1

References:

(1) Runkel, L., Pfeffer, L., Lewerenz, M., Mogensen, K. (1998). Differences in Activity between α and β Type I Interferons Explored by Mutational Analysis. J. Biol. Chem. 273: 8003-8008

(2) Stewart, A. G., Adair, J. R., Catlin, G., Hynes, C., Hall, J., Davies, J., Dawson, K. & Porter, A. G. (1987). Chemical mutagenesis of human interferon-beta: construction, expression in *E. coli*, and biological activity of sodium bisulfite-induced mutations. DNA 6: 119-128.

(3) In-house results

In still another embodiment of the present invention, the IFN is IFN-λ, (WO 2007/029041 A2), which may be used for any of the applications described more thoroughly for IFNα or IFNβ.

Type I IFNs can have anti-cancer activity based on a direct stimulation of the type I IFN receptor on cancer cells. This has been shown for numerous types of cancer including multiple myeloma, melanoma, B cell lymphoma, non-small cell lung cancer, renal cell carcinoma, hairy cell leukemia, chronic myelogenous leukemia, ovarian cancer, fibrosarcoma, cervical cancer, bladder cancer, astrocytoma, pancreatic cancer, etc (Borden, Cancer Research 42:4948-53, 1982; Chawla-Sarkar, Clinical Cancer Research 7: 1821-31, 2001; Morgensen, Int J. Cancer 28:575-82, 1981; Otsuka, British Journal of Haematology 103:518-529, 1998; Lindner, J of Interferon and Cytokine Research 17:681-693, 1997; Caraglia, Cell Death and Differentiation 6:773-80, 1999; Ma, World J Gastroenterol 11(10):1521-8, 2005). One of skill in the art will recognize that the present invention has many aspects resulting from combining antibodies to tumor associated antigens with mutated type I interferons, and that the resulting fusion protein constructs may be used to reduce the proliferation of various interferon-sensitive cancers that express the corresponding tumor associated antigens. It will also be appreciated that type I interferons can be combined with other agents to further improve their effectiveness.

Type I interferons can also display anti-viral properties. IFNα2b, for example, has been FDA-approved for the treatment of chronic hepatitis C infections, and may have utility in treating other viral infections as well. Pegylated IFN-α is currently part of the standard of care regimen for hepatitis C, according to American and European guidelines, but results in side effects in over 80% of patients, often leading to discontinuation of treatment (Aman, 2012; Calvaruso, 2011). In one aspect of the present invention, a type I IFN with an attenuating mutation is attached to an antibody that binds to virally infected cells. The antigen to be recognized by the above referenced antibody could be a viral protein that is transiently expressed on the host cell surface, or it could be an endogenous host cell-produced antigen that is exposed on the cell surface to a greater extent after viral infection than before infection. Exemplary viral proteins that could serve as targets for the antibody portion include but are not limited to, Hepatitis C viral envelope glycoproteins, E1 and E2; Hepatitis B surface antigen (HBsAg); Herpes virus viral envelope glycoproteins B, C, D, E, G, H, I, J, K, L, M and UL32, and envelope protein UL49A; Human immune deficiency virus (HIV) Envelope proteins glycoprotein (gp) 120 and gp41; Adenoviruses knob domain of the fiber protein; Varicella-zoster virus envelope glycoproteins (gB, gC, gE, gH, gI, gK, gL); Epstein-barr virus viral glycoprotein gp350 and viral protein BMRF-2; Human cytomegalovirus UL16; Parvovirus B19 viral capsid proteins VP1-3; Human astrovirus structural proteins, e.g. VP26, VP29 and VP32; Noroviruses structural protein VP1 and capsid protein VP2; Poliovirus viral capsid proteins VP0, VP1, VP2, VP3 and VP4; Rhinovirus viral capsid proteins VP1, VP2, VP3 and VP4; and dengue virus virus particle proteins capsid (C), pre-membrane/membrane (prM/M) and envelope (E).

In one embodiment, IFN-α activity may be targeted with an antibody that binds, directly or indirectly via an intermediate protein such as annexin V or beta2-glycoprotein 1, to phosphatidylserine (PS), a phospholipid component of the inner leaflet of cellular membranes. Cells undergoing apoptosis, however, or cells infected with viruses, expose PS on the outer membrane, where it becomes accessible to antibodies. PS is exposed on the surface of cancer cells (Reidl, L. et al., J Immunol. 14:3623, 1991), the vascular endothelium in tumors (Ran, S. et al., Cancer Res. 62:6132. 2002; He, J. et al., Clin Cancer Res. 15:6871, 2009), and virus-infected cells (Soares, M. et al., Nat. Med. 14:1357, 2008). An antibody indirectly (via beta2 glycoprotein 1) targeting PS, bavituximab, has been described. It mediates antibody-dependent cytotoxicity and is effective in a number of in vivo cancer models, including human breast and lymphoma xenografts and a rat glioblastoma model, as well as in viral disease models (Ran, S. et al., Clin Cancer Res; 11:1551, 2005; He, J. et al., Clin Cancer Res. 15:6871, 2009; Soares, M. et al., Nat. Med. 14:1357, 2008). Currently, it is being developed as a therapeutic antibody for lung cancer treatment (DeRose, P. et al., Immunotherapy. 3:933, 2011; Gerber, D. et al., Clin Cancer Res. 17:6888, 2011). Alternative antibodies may be based on the variable regions from the anti-PS antibody 9D2 (Cancer Res Nov. 1, 2002 62; 6132). Yet another alternative for targeting PS would be to replace the antibody Fab portions with a natural PS-binding protein such annexin V or beta2-glycoprotein 1. An anti-PS antibody (or alternatively a direct or indirect PS binding protein) fused with an attenuated version of IFN-α would target IFN-α activity to PS expressing virus-infected cells without displaying the systemic safety issues related to IFN-α. Certain tumor cells, such as lung cancer cells, also express PS on their cell surfaces, so an antibody (or alternatively a direct or indirect PS binding protein) to PS, attached to an attenuated IFN, could also have use in the treatment of certain cancers.

It should be understood that antibody-targeted attenuated IFNλ could also be used in much the same way as IFNα for the targeting virally infected cells (S. V. Kotenko, G. Gallagher, V. V. Baurin et al., "IFN-λs mediate antiviral protection through a distinct class II cytokine receptor complex," Nature Immunology, vol. 4, no. 1, pp. 69-77, 2003).

In one embodiment Type II IFNs, namely INFγ, may also be attenuated and attached to antibodies that direct them to specific cell types. IFNγ has anti-proliferative properties towards cancer cells (Kalvakolanu, Histol. Histopathol 15:523-37, 2000; Xu, Cancer Research 58:2832-7, 1998; Chawla-Sarkar, Apoptosis 8:237-49, 2003; Schiller, J Interferon Research 6:615-25, 1986). Sharifi has described how to make a fusion protein in which an IFNγ has been fused to the C-terminus of a tumor-targeting antibody (Sharifi, Hybridoma and Hybridomics 21(6):421-32, 2002). In this reference, Sharifi disclosed how to produce antibody-IFNγ fusion proteins in mammalian cells and showed that both the antibody and the IFN were functional. Alternatively, a single-chain dimer version of IFNγ, as described by Lander (J Mol. Biol. 2000 May 26; 299(1):169-79) may be used in the fusion protein. In addition to IFNγ's anti-proliferative effect on the targeted tumor cells, it may also have another effect specifically on breast cancer cells: IFNγ has been shown to restore antiestrogen sensitivity to breast cancer cells (Mol Cancer Ther. 2010 May; 9(5): 1274-1285) and so an attenuated-IFNγ attached to a breast cancer antigen antibody may be therapeutically useful in combination with antiestrogen therapy. By attenuating IFNγ via mutation, a more cancer-selective form of IFNγ may be produced. Two attenuating mutations in IFNγ have been described by Waschutza (Eur J. Biochem. 256:303-9, 1998), namely des-(A23, D24), in which residues A23 and D24 are deleted, and des-(N25, G26), in which residues N25 and G26 are deleted. The des-(A23, D24) mutant has an ~18-fold reduced affinity for the IFNγ receptor compared to wild type IFNγ, and had a ~100-fold reduced antiviral activity compared to wild type IFNγ. The des-(N25, G26) variant had a ~140-fold reduced affinity for the IFNγ receptor compared to wild type IFNγ, and had a ~10-fold reduced antiviral activity compared to wild type IFNγ. Examples of fusion proteins comprising antibodies to tumor cell surface targets and attenuated mutants of IFNγ include the following: Rituximab may be used as fusion protein with one of these attenuated IFNγ using a 7 amino acid linker described by Sharifi to produce the fusion protein construct "Rituximab-HC-L7-IFNλ(Δ[A23,D24]) IgG1," composed of SEQ ID NOS:378 (heavy chain) and 276 (light chain)). Such a fusion protein construct would be expected to have potent anti-proliferative activity against CD20 malignancies such as B cell lymphomas. Other attenuated mutants of IFNγ that may be appropriate for fusing to a cell-targeting antibody were described by Lundell (J. Biol. Chem. 269(23):16159-62, 1994), namely S20I (~50× reduced affinity), D21K (~100× reduced affinity), A23Q (~2,500-fold reduced binding), A23V (~2,000-fold reduced binding) and D24A (~4-fold reduced binding). These attenuated IFNγ may be used as fusions in combination with anti-CD38 antibodies, to generate the fusion protein construct "X355/02-HC-L7-IFNγ (S20I) IgG1" (composed of SEQ ID NOS:380 (heavy chain) and 226 (light chain)) or "R10A2-HC-L7-IFNγ (D21K) IgG1" (composed of SEQ ID NOS:382 (heavy chain) and 270 (light chain)). Other attenuating mutations in IFNγ that may be exploited for the current invention were described by Fish (Drug Des Deliv. 1988 February; 2(3):191-206.)

Targeted attenuated IFNγ may also be used to treat various indications characterized by pathological fibrosis, including kidney fibrosis, liver fibrosis and idiopathic pulmonary fibrosis (IPF). IPF is a chronic, progressive form of lung disease, characterized by fibrosis of unknown cause, occurring primarily in older adults. Despite the medical need, there has been little progress in the development of effective therapeutic strategies (O'Connell, 2011 Adv Ther 28:986). Pulmonary fibrosis can also be induced by exposure to drugs, particles, microorganisms or irradiation. The following relates to both IPF and lung fibrosis induced by known agents and potentially for treatment of fibrosis in other types of organs, including liver and kidney.

Fibroblasts play a key role in fibrotic diseases of the lung and their activation leads to collagen disposition, resulting in excessive scarring and destruction of the lung architecture. Yet there is little information on the origin of these pathogenic fibroblasts, though several precursor cell types have been proposed, including bone marrow progenitors, monocytes, circulating fibrocytes, and endogeneous cells, such as resident mesenchymal and epithelial cells (Stevens, 2008 Proc Am Thorac Soc 5:783; King, 2011 Lancet 378:1949).

CD14+ monocytes from peripheral blood are able to differentiate into fibrocytes, the precursors of fibroblasts, and this process is inhibited by interferon-γ (IFN-γ). A direct effect of IFN-γ on monocytes was demonstrated in in vitro differentiation studies, supporting the strategy of targeting an attenuated form of IFN-γ to CD14+ monocytes for the treatment of fibrotic disease (Shao, 2008 J Leukoc Biol 83:1323).

Experimental evidence exists that IFN-γ is capable of inhibiting proliferation and activation of fibroblasts (Rogliani, 2008 Ther Adv Respir Dis 2:75) and this fact has exploited successfully in preclinical models to reduce scaring and fibrosis. Clinical trials in IPF patients studying the benefit of subcutaneously administered IFN-γ failed to reach primary endpoints for survival benefits (O'Connell, 2011 Adv Ther 28:986; King, 2011). Current approaches focus on direct delivery of recombinant IFN-γ through inhalation of an aerosol form (Diaz, 2012 J Aerosol Med Pulm Drug Deliv 25:79), such that the lungs may achieve sufficient IFN-γ activity to produce benefit at an overall safe systemic dose.

Delivering IFN-γ activity directly to fibroblasts could be a powerful method to increase clinical response to this agent and at the same time reduce its side effects. Fusing attenuated IFN-γ to antibodies targeting fibroblast specific markers could facilitate this approach. There are several fibroblast cell surface molecules that are enriched in fibroblasts. These include, for example, fibroblast specific protein (FSP1; Strutz, 1995 J Cell Biol 130:393), fibroblast activation protein (FAP; Park, 1999 J Biol Chem 274:36505; Acharya, 2006 Hum Pathol 37:352), and platelet derived growth factor receptors (PDGFR-α and -β; Trojanowska, 2008 Rheumatology (Oxford) 47S5:2). Expression of these molecules is elevated in lung biopsies obtained from IPF patients and they have been directly implicated as drug targets in IPF or its pathogenesis (Lawson, 2005 Am J Respir Crit. Care Med 171:899; Acharya, 2006 Hum Pathol 37:352; Abdollahi, 2005 J Exp Med 201:925). Examples of antibodies to FAP and the PDGF receptors are shown in Tables 15 and 16.

TABLE 15

FAP Antibodies

| Ab Clones | Patent | Assignee | Comments |
|---|---|---|---|
| MFP5, BIBH1 | US2009/0304718 | Boehringer Ingelheim USA Corporation | Humanized |
| Many F19 | US2012/0128591 US2003/0143229 | Bacac et al. Boehringer Ingelheim International GmbH | Humanized |

TABLE 16

PDGFR-α and -β Antibodies

| Ab Clones | Patent | Assignee | Comments |
|---|---|---|---|
| 2.175.3, 2.499.1, 2.998.2 | U.S. Pat. No. 7,754,859 | AstraZeneca AB | Human abs against PDGFRα |
| IMC-3G3 | US2012/0027767 | Imclone LLC | Human abs against PDGFRα |
| 2C5 | US2012/00221267 | Imclone LLC | Human abs against PDGFRβ |

In a preclinical model of liver fibrosis, IFN-γ was delivered to hepatic stellate cells, the equivalent of fibroblasts and responsible for secreting collagen in liver fibrosis, through liposomes targeting PDGFR-β, thereby enhancing the antifibrotic effects of IFN-γ (Li, 2012 J Control Release 159: 261). These data support the concept and the potential therapeutic benefit gained by delivering IFN-γ activity directly to fibroblasts in fibrotic diseases, including IPF and liver fibrosis, and validate PDGFR-β as a target for this approach.

The present invention also contemplates the attenuation and antibody-based targeting of type III IFNs, including IFNλ1 (IL29), IFNλ2 (IL28A), and IFNλ3 (IL28B) (S. V. Kotenko, G. Gallagher, V. V. Baurin et al., "IFN-λs mediate antiviral protection through a distinct class II cytokine receptor complex," Nature Immunology, vol. 4, no. 1, pp. 69-77, 2003. P. Sheppard, W. Kindsvogel, W. Xu, et al., "IL-28, IL-29 and their class II cytokine receptor IL-28R," Nature Immunology, vol. 4, no. 1, pp. 63-68, 2003). These IFNs act through receptors composed of the IFNλR1 chain (also known as IL28Rα) and the IL10R2 chain (shared with IL10, IL22, and IL26 receptor complexes [A. Lasfar, W. Abushahba, M. Balan, and K. A. Cohen-Solal, "Interferon lambda: a new sword in cancer immunotherapy," Clinical and Developmental Immunology, vol. 2011, Article ID 349575, 11 pages, 2011]). IFNλRs are expressed on most cell types and mediate similar signalling pathways as the type I IFNs. The antiviral activity of λ IFNs has been demonstrated against several viruses including HBV and HCV (E. M. Coccia, M. Severa, E. Giacomini et al., "Viral infection and toll-like receptor agonists induce a differential expression of type I and λ interferons in humans plasmacytoid and monocyte-derived dendritic cells," European Journal of Immunology, vol. 34, no. 3, pp. 796-805, 2004; M. D. Robek, B. S. Boyd, and F. V. Chisari, "Lambda interferon inhibits hepatitis B and C virus replication," Journal of Virology, vol. 79, no. 6, pp. 3851-3854, 2005; N. Ank, H. West, C. Bartholdy, K. Eriksson, A. R. Thomsen, and S. R. Paludan, "Lambda interferon (IFN-λ), a type III IFN, is induced by viruses and IFNs and displays potent antiviral activity against select virus infections in vivo,"

*Journal of Virology*, vol. 80, no. 9, pp. 4501-4509, 2006; S. E. Doyle, H. Schreckhise, K. Khuu-Duong et al., "Interleukin-29 uses a type 1 interferon-like program to promote antiviral responses in human hepatocytes," *Journal of Hepatology*, vol. 44, no. 4, pp. 896-906, 2006; T. Marcello, A. Grakoui, G. Barba-Spaeth et al., "Interferons α and λ inhibit hepatitis C virus replication with distinct signal transduction and gene regulation kinetics," *Gastroenterology*, vol. 131, no. 6, pp. 1887-1898, 2006). Clinical studies with IFNλ for the treatment of hepatitis C have shown promise (E. L. Ramos, "Preclinical and clinical development of pegylated interferon-lambda 1 in chronic hepatitis C," *Journal of Interferon and Cytokine Research*, vol. 30, no. 8, pp. 591-595, 2010). One aspect of the present invention is to target a mutated, attenuated for of an IFNλ towards virally infected cells, using for example the targeting antibodies describe above for the targeting of an attenuated form of IFNα. Mutated, attenuated forms of an IFNλ could also be used to target cancer cells, as described in more detail for IFNα, above.

Non-IFN ligands are also contemplated in the present invention and may also be attenuated by mutation and then targeted to specific cell types by antibodies or fragments thereof. The anti-inflammatory cytokine interleukin-10 (IL-10) plays a central role during innate and adaptive immune responses. IL-10 forms a homodimer and binds to the IL-10 receptor complex expressed on APCs, leading to reduced expression of MHC class II and reduced production of pro-inflammatory cytokines and chemokines, thereby inhibiting T cell development and differentiation. However, IL-10 has also been implicated in inducing the proliferation of several immune cells, including B cells (Hofmann, 2012 Clin Immunol 143:116).

Reduced expression of IL-10 is associated with a number of autoimmune disorders in humans and rodents, including psoriasis, inflammatory bowel disease and rheumatoid arthritis. Mice deficient in IL-10 develop chronic enterocolitis, which can be prevented by the administration of IL-10, but the clinical translation of these findings resulted in a number of failed trials in patients. One explanation of these failures is that the local IL-10 concentrations may be too low, even at maximum tolerable systemic administration (Herfarth, 2002 Gut 50:146). Another explanation may be the immunostimulatory effect of IL-10 on B cells and the resulting production of the pro-inflammatory IFN-γ, as was demonstrated in IL-10-treated Crohn's disease patients (Tilg, 2002 Gut 50:191).

Fusing attenuated IL-10 to an antibody specific for APCs, e.g. targeting dendritic cells through CD11c, or more broadly expressed myeloid markers, like CD33 or CD115, would decrease systemically active biologic activity and at the same time increase the targeted local active concentrations of IL-10. In addition, the demonstrated pro-inflammatory effect through B cells would be decreased or eliminated. The production of antibody-IL10 fusion proteins have been described previously (Schwager Arthritis Res Ther. 11(5): R142, 2009).

Evidence exists for an anti-fibrotic role of IL-10 in various models. A hallmark of fibrosis is the overproduction and deposition of collagen produced by fibroblasts, resulting in scarring tissue formation. IL-10 directly inhibits extracellular matrix synthesis by human fibroblasts (Reitamo, 1994 J Clin Invest 94:2489) and is anti-fibrotic in a rat hepatic fibrosis model through downregulation of TGF-β (Shi, 2006 World J Gastroenterol 12:2357; Zhang, 2007 Hepatogastroenterology 54:2092). Clinical use of IL-10 is hampered by its short half-life and a PEGylated version has shown promising pharmacokinetic improvements and efficacy in a preclinical model of fibrosis (Mattos, 2012 J Control Release 162:84). Targeting IL-10 activity through fusion with an antibody directing it to fibroblasts could result in therapeutic benefits in fibrotic diseases, including lung and liver fibrosis. Antibodies against fibroblast specific proteins such as fibroblast activation protein and platelet derived growth factor receptors, as described above in the description of IFN-γ-targeting, could deliver attenuated IL-10 directly to fibroblasts.

Recombinant erythropoietin (EPO) is a widely used and effective hormone for the treatment of anemia, often in cancer patients. It acts by signaling through the EPO receptor (EPOR), which is not only expressed by cells of the hematopoietic system, but also on non-hematopoietic cells, including cells from various tumor types. Many studies have examined the role of EPO and EPO-R stimulation in cancer models in vitro and in vivo, and a number of studies have demonstrated a stimulatory effect on tumor growth, either directly on cancer cells, or through increased angiogenesis in the tumors (reviewed in Jelkmann, 2008 Crit. Rev Oncol Hematol 67:39). In several clinical trials, treatment with EPO has been associated with increased tumor growth and decreased survival, leading to the recommendation and black box warning to limit and monitor the exposure of EPO in cancer patients as much as clinically feasible (Farrell, 2004 The Oncologist 9:18; Jelkmann, 2008 Crit. Rev Oncol Hematol 67:39; Elliott, 2012).

Erythropoiesis is a multi-step process, in which pluripotent stem cells undergo tightly controlled differentiation and proliferation steps. An intermediate cell type in this process, is the colony-forming-unit-erythroid (CFU-E) cell, which expresses high levels of EPOR, depends on EPO for survival and appears to be the main cell type in the differentiation process with this dependency (Elliott, 2008 Exp Hematol 36:1573).

Targeting EPO activity to CFU-E cells using specific markers would substantially reduce the effect of EPO on cancer and other non-hematopoietic cells, while maintaining the ability to drive erythrocyte formation and increase hemoglobin levels. Genome-wide analysis of CFU-E cells revealed several potential candidate cellular markers, including Rh-associated glycoproteins, e.g. CD241 and members of the Rh blood group system, e.g. the product of the RCHE gene (Terszowski, 2005 Blood 105:1937).

Additional example surface markers expressed on CFU-Es, and several other intermediates of erythropoiesis, include CD117 (c-kit), CD71 (transferrin receptor) and CD36 (thrombospondin receptor) (Elliott, 2012 Biologics 6:163), but these markers are overexpressed in certain cancer cells as well, as they are all involved in general growth and proliferation, and therefore represent less attractive targets for targeting EPO activity in cancer patients, but this approach may benefit patients with tumors not expressing these targets. CD117 antibodies include SR-1 (U.S. Pat. No. 7,915,391) and antibodies DSM ACC 2007, 2008 and 2009 (U.S. Pat. No. 5,545,533). Other antigens for targeting of an attenuated EPO include CD34, CD45RO, CD45RA, CD115, CD168, CD235, CD236, CD237, CD238, CD239 and CD240.

Fusing EPO activity to an antibody would also greatly increase the extent of the therapeutic activity. The half-life of recombinant EPO is about 5 hours in humans and this would likely be increased to weeks when attenuated EPO is fused to an antibody. This approach could benefit patients treated for anemia, who are dosed typically multiple times per week, often through intravenous injections. Importantly, it has been shown that the therapeutic response to EPO is primarily controlled by the length of time EPO concentrations are maintained, and not by the concentration levels (Elliott, 2008 Exp Hematol 36:1573).

Another example is transforming growth factor β (TGF-β) which is a critical factor in the regulation of T cell-mediated immune responses and the induction of immune tolerance. TGF-β knockout mice die from multifocal inflammation and autoimmune disorders, suggesting an immunosuppressive effect (Shull, 1992 Nature 359:693). However, TGF-β also has been shown to induce fibrotic disease through a prominent role in extracellular matrix regulation and by promoting fibroblast migration, proliferation and activation (Rosenbloom, 2010 Ann Intern Med 152:159; Wynn, 2011 J Exp Med 208:1339; King, 2011 Lancet 378:1949).

In the presence of TGF-β, $CD4^+CD25^-$ naïve T cells can be converted into Treg cells, which can suppress antigen-specific T cell expansion in vivo and prevent allergic pathogenesis in a murine asthma model (Chen, 2003 J Exp Med 198:1875). Inflammatory responses also contribute to the transition of acute liver disease and perpetuation into chronic fibrosis and cirrhosis and TGF-β may help dampen these responses through its effect on Treg differentiation (Dooley, 2012 Cell Tissue Res 347:245). Similarly, TGF-β directed to naïve T cells in inflammatory bowel disease could lead to control and suppression of inflammation (Feagins, 2010 Inflamm Bowel Dis 16:1963).

Targeting TGF-β specifically to $CD4^+$ T cells may leverage the anti-inflammatory potential of TGF-β, while minimizing its pro-fibrotic properties, and could provide a novel strategy to combat autoimmune disorders. Alternatively, TGF-β could be targeted soley to activated T cells using a T cell activation marker, as described above for the discussion of IFNβ targeting. One attractive target along these lines could be, for example, PD-1, which is expressed on recently activated CD4 T cells. Ideally, a non-antagonizing antibody could be used, such as the J110 antibody discussed in further detail below.

Another example is Interleukin-4 (IL-4) which is a cytokine that induces the differentiation of naïve CD4+ T cells into Th2 cells. Upon activation, Th2 cells produce more IL-4, and as a result, IL-4 is considered a main driver of Th2-mediated immune responses. The concept of a Th1/Th2 imbalance (favoring Th1) contributing to autoimmune and other inflammatory diseases was first postulated in the 1980s (reviewed in Kidd, 2003 Altern Med Rev 8:223), and indeed, a role of Th1/Th17 cells as drivers of disease in psoriasis (Ghoreschi, 2007 Clin Dermatol 25:574), certain types of inflammatory bowel disease, in particular Crohn's disease (Sanchez-Munoz, 2008 World J Gastroenterol 14:4280), or severe versus mild forms of asthma (Hansbro, 2011 Br J Pharmacol 163:81), has been documented.

In preclinical models of infectious diseases, deviation of the immune response away from Th1 to Th2 and activation of macrophages by IL-4 protected from immunopathology (Hunig, 2010 Med Microbiol Immunol 199:239), and IL-4 therapy of psoriasis patients resulted in an induction of Th2 differentiation and an improvement in clinical scores (Ghoreschi, 2003 Nat Med 9:40).

Diversion towards Th2 may provide a therapeutic benefit in certain types of diseases. Delivery of IL-4 to $CD4^+$ T cells could accomplish this, or IL-4 activity could be targeted to macrophages to protect from immunopathology (Ghoreschi, 2007 Clin Dermatol 25:574; Hunig, 2010 Med Microbiol Immunol 199:239).

Attenuating mutations in IL-4 that may be exploited in the design of antibody-attenuated IL-4 fusion protein constructs of the present invention include those listed in Table 17.

TABLE 17

| IL4 Variant | $K_{off} \times 10^3$ $S^{-1}$ | $EC_{50}$ T cell proliferation (nM) |
|---|---|---|
| IL4 | 2.1 | 0.12 |
| I5R | 8.7 | |
| T6D | 15 | |
| E9Q | 270 | 3.1 |
| R81E | 6.1 | |
| K84D | 9.3 | |
| R88Q | 140 | 2.5 |
| R88A | 760 | 8.1 |
| N89R | 6.1 | |
| W91D | 8.5 | |

ND. No specific binding found.

The IL-4 mutants in this table, and their binding properties and biological activity, were described by Wang Y, Shen B and Sebald W. Proc. Natl. Acad. Sci. USA 1997 Mar. 4; 94(5): 1657-62.

In yet another example, Interleukin-6 (IL-6) may also be attenuated and targeted to specific cell types. A mechanism by which tumors can evade anti-tumor immunity is by recruiting Treg cells to the tumor microenvironment, resulting in tolerance at tumor sites. IL-6 is a cytokine involved in regulating the balance between Treg and Th17 cells and induces the development of Th17 cells, while it inhibits Treg differentiation (Kimura, 2010 Eur J Immunol 40:1830).

IL-6, by skewing the terminal differentiation of naïve $CD4^+$ T cells towards the Th17 lineage, or reprogramming of Th17 cells, has the potential to reverse tumor-associated immune suppression by Treg cells in the context of cancer, thereby enabling the immune system to control the tumors.

This strategy has proven successful in a murine model of pancreatic cancer in which mice injected with tumor cells expressing IL-6 demonstrated a significant delay in tumor growth and enhanced survival, accompanied by an increase in Th17 cells in the tumor microenvironment, compared to mice bearing tumors not expressing IL-6 (Gnerlich, 2010 J Immunol 185:4063).

Adoptive transfer of T cells is an effective treatment for solid (Rosenberg, 2011 Clin Cancer Res 17:4550) and hematologic (Kochenderfer, 2012 Blood 119:2709) malignancies. Analysis of five different clinical trials in which adoptive T cell transfer was employed using a variety of preconditioning regimens revealed that the depth and duration of Treg depletion correlates with clinical response rate, highlighting the important role of residual Tregs controlling the anti-tumor response (Yao, 2012 Blood 119:5688). In mice, a direct link between surviving Tregs and efficacy of adoptive transfer therapy strongly supports these clinical observations (Baba, 2012 Blood 120:2417).

The importance of Tregs in controlling anti-tumor activity is further exemplified by a significant increase in the humoral response to peptide vaccination in glioblastoma patients after depletion of Tregs with the anti-IL-2 receptor antibody daclizumab (Sampson, 2012 PloS ONE 7:e31046).

Taken together, the published data strongly support a role for Tregs in inhibiting the immune response against tumors. By directing IL-6 activity to CD4+ cells in order to stimulate Th17 differentiation and decrease Treg formation, enhanced anti-tumor responses are expected. These may be achieved with or without accompanying vaccination strategies. Fusing attenuated IL-6 to an antibody against a T cell antigen (e.g. targeting CD4) or an activated T cell antigen (such as PD-1) would provide a comprehensive delivery directly to the target cells.

Attenuated mutants of IL-6 include those listed in Table 18.

TABLE 18

| IL6 Variant | Binding (% of wild type) | EC$_{50}$ in XG-1 growth stimulation assay (pg/ml) |
| --- | --- | --- |
| IL6 | 100 | 600 |
| F74E | 1 | Low activity |
| F78E | 5 | Low activity |
| R168M | 2 | Low activity |
| R179E | None detected | Low activity |
| R179W | None detected | Low activity |

These IL-6 mutants and their properties were described by Kalai M et. al. Blood. February 15; 89(4):1319-1333

Another example is hepatocyte growth factor (HGF) discovered as a mitogen for hepatocytes (reviewed in Nakamura, 2010 Proc Jpn Acad Ser B Phys Biol Sci 86:588). Hepatocyte growth factor is a pleiotropic cytokine that regulates cell growth and motility, playing a central role in angiogenesis and tissue generation and repair in many organs.

HGF acts through its receptor, MET, which is expressed on epithelial and endothelial cells. Binding of HGF to MET results in a number of intracellular phosphorylation and signaling events, leading to a variety of biological responses including migration, proliferation and morphogenesis. Essential for embryogenesis, HGF's primary function in the adult is tissue repair (Nakamura, 2010 Proc Jpn Acad Ser B Phys Biol Sci 86:588).

HGF has been shown to alter the fate of epithelial cells and reduce epithelial-mesenchymal transition (EMT) through its intereference with TGF-β signaling, antagonizing the process of fibroblastogenesis (Shukla, 2009 Am J Respir Cell Mol Biol 40:643). After organ injury, TGF-β drives conversion of HGF-producing fibroblasts into collagen-producing myofibroblasts, while HGF in turn inhibits TGF-β production by myofibroblasts (Mizuno, 2004 Am J Physiol Renal Physiol 286:F134). Exogeneous HGF, or mimetics activating the MET receptor, act by restoring this imbalance imposed by tissue injury, and are therefore considered promising drug candidates for treating damaged tissues and fibrotic diseases (Nakamura, 2010 Proc Jpn Acad Ser B Phys Biol Sci 86:588).

Initially studied in models for liver damage and hepatitis (Roos, 1992 Endocrinology 131:2540; Ishiki, 1992 Hepatology 16:1227), HGF subsequently demonstrated therapeutic benefits in many additional damaged organs, including pulmonary, gastrointestinal, renal and cardiovascular models of injury and fibrosis (Nakamura, 2011 J Gastroenterol Hepatol 26:188).

In in vivo model systems of fibrosis, HGF prevents the progression of fibrotic changes and reduces collagen accumulation when administered prophylactically or therapeutically in murine lungs exposed to bleomycin (Yaekashiwa, 1997 Am J Respir Crit. Care Med 156:1937; Mizuno, 2005 FASEB J 19:580), in an obstructive nephropathy model in mice (Yang, 2003 Am J Physiol Renal Physiol 284:F349) and in liver fibrosis models in rats (Matsuda, 1997 Hepatology 26:81); HGF also prevents fibrosis in cardiomyopathic hamsters (Nakamura, 2005 Am J Physiol Heart Circ Physiol 288:H2131).

Limitations of HGF as a therapeutic include its short half-life, which requires supra-physiological systemic concentrations to reach locally effective levels, and the role of its receptor, MET, in cancer. MET can activate oncogenic pathways in epithelial cells. Both of these limitations may be overcome by generation of an antibody-HGF fusion protein construct and targeting it to regenerating or fibrotic tissue. This strategy would produce a therapeutic with a much longer half-life directed primarily at the relevant cells types.

Clinical trials have investigated the therapeutic potential and regenerative activity of HGF, or HGF mimetics, in hepatic failure, chronic leg ulcers, limb ischemic, peripheral arterial disease, cardiovascular disease after myocardial infarction and neurological diseases (de Andrade 2009 Curr Opin Rheumatol 21:649; Nakamura, 2011 J Gastroenterol Hepatol 26:188; Madonna, 2012 Thromb Haemost 107: 656).

Liver fibrosis, typically the result of chronic liver damage caused by infections or alcohol abuse, is, like fibrosis in other organs, characterized by excessive accumulation of extracellular matrix, including collagen produced by (myo) fibroblasts. Damaged hepatocytes release inflammatory cytokines and the resulting inflammatory milieu stimulates the transformation of hepatic stellate cells (HSC) into fibroblasts, producing collagen. The accumulation of extracellular matrix proteins results in scar tissue, which leads to liver cirrhosis (Bataller, 2005 J Clin Invest 115:209). Evidence exists for a direct effect of HGF on hepatocytes and HSC in vitro (Kwiecinski, 2012 PloS One 6:e24568; Namada, 2012 J Cell Physiol DOI 10.1002/jcp.24143). Targeting HGF specifically to hepatocytes or HSC may result in a therapeutic benefit in liver fibrosis patients, while eliminating the unwanted systemic effects of HGF.

Possible membrane proteins for hepatocytes include, for example, ASGR1, a subunit of the asialoglycoprotein, used as a target for liver specific drug delivery (Stockert, 1995 Physiol Rev 75:591), or alternatively the other subunit of this receptor, ASGR2. Fibroblast-specific protein (FSP1) expression is increased after liver injury and may be used to target fibroblasts or inflammatory macrophages in fibrotic liver tissue (Osterreicher, 2011 Proc Natl Acad Sci USA 108:308).

In lung fibrosis patients, the loss of pulmonary architecture is characterized by a loss of alveolar epithelial cells, the persistent proliferation of activated fibroblasts and the extensive alteration of the extracellular matrix (Panganiban, 2011 Acta Pharmacol Sin 32:12).

To treat lung fibrosis, HGF activity may be delivered to alveolar epithelial cells by attenuating it (by mutation) and attaching it to an antibody against a specific cell surface protein on these cells, such as RTI40/Tiα or HTI56 (McElroy, 2004 Eur Respir J 24:664).

Endothelial cell-specific markers, including VEGF receptors (Stuttfeld, 2009 IUBMB Life 61:915) may be used for targeting blood vessels for endothelial cell layer enhancement for a number of pathologic indications, including hindlimb ischemia. Examples of VEGF receptor antibodies are shown in Table 19.

TABLE 19

VEGFR Antibodies

| Ab Clones | Patent | Assignee | Comments |
|---|---|---|---|
| AC88 | U.S. Pat. No. 8,128,932 | Shanghai Aosaiersi Biotech Co., Ltd | Human anti-VEGFR2 mAb |
| Antibody 1, Antibody 2 | US2012/0058126 | Imclone LLC | Anti-VEGFR3 Abs |
| 6A6 | US2011/0065176 | Korea Research Institute of BioScience and BioTechnology | Human, anti-VEGFR |

Many other examples of signaling ligands are also known in the art and may, as described in the non-limiting exemplary embodiments above, be attenuated and attached to an antibody (or fragment thereof) that binds to an antigen on specific target cells, thereby allowing the ligand to generate its biological signal on those target cells to a much greater degree than it generates its signal on antigen-negative cells. Examples of ligands that have a direct negative effect on tumor proliferation include TNFα, TRAIL, Fas Ligand, IFNβ, IFNγ or IFNλ, which can be targeted to various tumor cell surface antigens as discussed above for INFα.

In many of the aspects of the present invention, specific mutations in various ligands are explicitly mentioned. There are, however, methods well known in the art for identifying other mutations in signalling ligands numerous methods for mutagenesis of proteins are known in the art. Such methods include random mutagenesis for example, exposing the protein to UV radiation or mutagenic chemicals and selecting mutants with desired characteristics. Random mutagenesis may also be done by using doped nucleotides in oligonucleotides synthesis, or conducting a PCR reaction in conditions that enhance misincorporation of nucleotide, thereby generating mutants. Another technique is site-directed mutagenesis which introduces specific changes to the DNA. One example of site directed mutagenesis is using mutagenic oligonucleotides in a primer extension reaction with DNA polymerase. This method allows for point mutation, or deletion or insertion of small stretches of DNA to be introduced at specific sites. The site-directed approach may be done systematically in such technique as alanine scanning mutagenesis whereby residues are systematically mutated to alanine and its effect on the peptide's activity is determined. Each of the amino acid residues of the peptide is analyzed in this manner to determine the important regions of the peptide.

Another example is combinatorial mutagenesis which allows the screening of a large number of mutants for a particular characteristic. In this technique, a few selected positions or a short stretch of DNA may be exhaustively modified to obtain a comprehensive library of mutant proteins. One approach of this technique is to excise a portion of DNA and replaced with a library of sequences containing all possible combinations at the desired mutation sites. The segment may be at an enzyme active site, or sequences that have structural significance or immunogenic property. A segment however may also be inserted randomly into the gene in order to assess the structural or functional significance of particular part of protein.

Methods of screening mutated ligands to determine potency includes assaying for the presence of a complex between the ligand and the target. One form of assay involves competitive binding assays. In such competitive binding assays, the target is typically labeled. Free target is separated from any putative complex and the amount of free (i.e. uncomplexed) label is a measure of the binding of the agent being tested to target molecule. One may also measure the amount of bound, rather than free, target. It is also possible to label the compound rather than the target and to measure the amount of compound binding to target in the presence and in the absence of the drug being tested.

One example of a cell free assay is a binding assay. Whilst not directly addressing function, the ability of a modulator to bind to a target molecule in a specific fashion is strong evidence of a related biological effect. For example, binding of a molecule to a target may, in and of itself, be inhibitory, due to steric, allosteric or charge-charge interactions. The target may be either free in solution, fixed to a support, expressed in or on the surface of a cell. Either the target or the compound may be labeled, thereby permitting determination of binding. Usually, the target will be the labeled species, decreasing the chance that the labeling will interfere with or enhance binding. Competitive binding formats can be performed in which one of the agents is labeled, and one may measure the amount of free label versus bound label to determine the effect on binding.

Depending on the assay, culture may be required. The cell is examined using any of a number of different physiologic assays. Alternatively, molecular analysis may be performed, for example, protein expression, mRNA expression (including differential display of whole cell or polyA RNA) and others. Non-limiting examples of in vitro biological assays that can be used to screen protein variants are shown in the Examples below and also include apoptosis assays, migration assays, invasion assays, caspase-activation assays, cytokine production assays and the like.

The present invention also provides compositions comprising the polypeptides of the present invention. These compositions can further comprise at least one of any suitable auxiliary, such as, but not limited to, diluent, binder, stabiliser, buffers, salts, lipophilic solvents, preservative, adjuvant or the like. Pharmaceutically acceptable auxiliaries are preferred. Non-limiting examples of, and methods of preparing such sterile solutions are well known in the art, such as, but not limited to, Gennaro, Ed., Remington's Pharmaceutical Sciences, 18th Edition, Mack Publishing Co. (Easton, Pa.) 1990. Pharmaceutically acceptable carriers can be routinely selected that are suitable for the mode of administration, solubility and/or stability of the antibody composition as well known in the art or as described herein.

Pharmaceutical excipients and additives useful in the present composition include but are not limited to proteins, peptides, amino acids, lipids, and carbohydrates (e.g., sugars, including monosaccharides, di-, tri-, tetra-, and oligosaccharides; derivatised sugars such as alditols, aldonic acids, esterified sugars and the like; and polysaccharides or sugar polymers), which can be present singly or in combination, comprising alone or in combination 1-99.99% by weight or volume. Exemplary protein excipients include serum albumin, such as human serum albumin (HSA), recombinant human albumin (rHA), gelatin, casein, and the like. Representative amino acids which can also function in a buffering capacity include alanine, glycine, arginine, betaine, histidine, glutamic acid, aspartic acid, cysteine, lysine, leucine, isoleucine, valine, methionine, phenylalanine, aspartame, and the like. One preferred amino acid is histidine. A second preferred amino acid is arginine.

Carbohydrate excipients suitable for use in the invention include, for example, monosaccharides, such as fructose, maltose, galactose, glucose, D-mannose, sorbose, and the like; disaccharides, such as lactose, sucrose, trehalose, cellobiose, and the like; polysaccharides, such as raffinose, melezitose, maltodextrins, dextrans, starches, and the like; and alditols, such as mannitol, xylitol, maltitol, lactitol, xylitol sorbitol (glucitol), myoinositol and the like. Preferred carbohydrate excipients for use in the present invention are mannitol, trehalose, and raffinose.

Antibody compositions can also include a buffer or a pH adjusting agent; typically, the buffer is a salt prepared from an organic acid or base. Representative buffers include organic acid salts, such as salts of citric acid, ascorbic acid, gluconic acid, carbonic acid, tartaric acid, succinic acid, acetic acid, or phthalic acid; Tris, tromethamine hydrochloride, or phosphate buffers. Preferred buffers for use in the present compositions are organic acid salts, such as citrate.

Additionally, the compositions of the invention can include polymeric excipients/additives, such as polyvinylpyrrolidones, ficolls (a polymeric sugar), dextrates (e.g., cyclodextrins, such as 2-hydroxypropyl-β-cyclodextrin), polyethylene glycols, flavoring agents, antimicrobial agents, sweeteners, antioxidants, antistatic agents, surfactants (e.g., polysorbates such as "TWEEN® 20" and "TWEEN® 80"), lipids (e.g., phospholipids, fatty acids), steroids (e.g., cholesterol), and chelating agents (e.g., EDTA).

These and additional known pharmaceutical excipients and/or additives suitable for use in the antibody compositions according to the invention are known in the art, e.g., as listed in "Remington: The Science & Practice of Pharmacy", 19 th ed., Williams & Williams, (1995), and in the "Physician's Desk Reference", 52 nd ed., Medical Economics, Montvale, N.J. (1998), the disclosures of which are entirely incorporated herein by reference. Preferred carrier or excipient materials are carbohydrates (e.g., saccharides and alditols) and buffers (e.g., citrate) or polymeric agents.

Throughout this specification the word "comprise", or variations such as "comprises" or "comprising", will be understood to imply the inclusion of a stated element, integer or step, or group of elements, integers or steps, but not the exclusion of any other element, integer or step, or group of elements, integers or steps.

All publications mentioned in this specification are herein incorporated by reference. Any discussion of documents, acts, materials, devices, articles or the like which has been included in the present specification is solely for the purpose of providing a context for the present invention. It is not to be taken as an admission that any or all of these matters form part of the prior art base or were common general knowledge in the field relevant to the present invention as it existed in Australia or elsewhere before the priority date of each claim of this application.

It must be noted that, as used in the subject specification, the singular forms "a", "an" and "the" include plural aspects unless the context clearly dictates otherwise. Thus, for example, reference to "a" includes a single as well as two or more; reference to "an" includes a single as well as two or more; reference to "the" includes a single as well as two or more and so forth.

Having generally described the invention, the same will be more readily understood by reference to the following examples, which are provided by way of illustration and are not intended as limiting.

EXAMPLES OF THE INVENTION

Production of Antibody-IFNα Fusion Protein Constructs Expression Vectors:

The DNA encoding the rituximab (Anderson et al., U.S. Pat. No. 5,843,439, Dec. 1, 1998) and palivizumab (Johnson, U.S. Pat. No. 5,824,307, Oct. 20, 1998) variable regions were generated from 18 (heavy chain) and 16 (light chain) DNA oligonucleotides, which were designed according to the published amino acid sequences, by PCR-based gene assembly. The DNA encoding the variable regions of the G005 anti-CD38 and nBT062 anti-CD138 monoclonal antibodies were drawn from the publications by De Weers et al. (U.S. Pat. No. 7,829,673) and by Daelken et al. (WO 2009/080832), respectively, and subjected to be synthesized by Integrated DNA Technology, Inc. (Coralville, Iowa) after the sequence modification to eliminate rare codons and unpreferred restriction sites.

The DNA sequences encoding the variable regions of anti-human HLA (HB95), anti-human PD-1 (J110) and anti-yellow fever virus (2D12) monoclonal antibodies were determined after cloning from hybridoma W6/32 (ATCC HB-95, Barnstable et al. (1978), Cell 14:9-20), J110 (International Patent Organism Depositary FERM-8392, Iwai et al. (2002), Immunol. Lett, 83:215-220) and 2D12 (ATCC CRL-1689, Schlesinger et al. (1983), Virol. 125:8-17), respectively, using the SMART RACE cDNA Amplification kit (Clontech, Mountain View, Calif.) and Mouse Ig-Primer Sets (Novagen/EMD Chemicals, San Diego, Calif.). The sequence determination and sub-cloning of the newly isolated anti-CD38 antibodies is described in the following sections.

The DNA encoding human interferon-α2b (IFNα2b; amino acid sequence of SEQ ID NO:3) was isolated from genomic DNA of a HEK cell line by PCR. The sequences of human interferon-β1 (IFNβ1, SEQ ID NO:91), human interleukin-4 (IL-4, SEQ ID NO:119) and human interleukin-6 (IL-6, SEQ ID NO:123) were designed from the protein sequences such as NP_002167, NP_000580 and NP_000591, respectively, and synthesized by Integrated DNA Technology, Inc. (Coralville, Iowa) or GenScript USA Inc. (Piscataway, N.J.) using methods commonly known to those of skill in the art. Alterations of the cytokine sequences, for example the addition of linkers or point mutations, were introduced to the cytokine genes using overlap extension PCR techniques well known in the art.

The cytokine-endoding gene fragments were then cloned into the pTT5 expression vector (Durocher, Nucleic Acids Research volume 30, number 2, pages E1-9, 2002) containing either a human IgG1 heavy chain complete or partial constant region (such as Swissprot accession number PO1857), a human IgG4 heavy chain constant region (such as Swissprot accession number P01861 incorporating substitution S228P), human Ig kappa constant region (Swissprot accession number P01834) or human Ig lambda constant region (Swissprot accession number P0CG05) either as a naked Ig or as a cytokine gene fusion form using overlap extension PCR techniques and restriction sites according to cloning methods well known by those skilled in the art.

Production of IgG and IgG Interferon Fusion Protein Constructs:

DNA plasmids encoding the IgGs and IgG-cytokine fusion protein constructs were prepared using Plasmid Plus Maxi kit (Qiagen, Valencia, Calif.) and then transfected into HEK293-6E cells (CNRC, Montreal, Canada) grown in F17 synthetic medium supplemented with 0.1% Pluronic F-68, 4 mM L-glutamine (Invitrogen, Carlsbad, Calif.) using a commercially available transfection reagent and OptiMEM medium (Invitrogen, Carlsbad, Calif.). After allowing for expression for 6 days in an incubator supplied with 5% $CO_2$ and gentle shaking, the culture media was isolated and subjected to IgG affinity purification using Protein G-agarose beads (GE Healthcare, Piscataway, N.J.). Purified IgG and IgG-cytokine fusion protein constructs were then concentrated and buffer-exchanged to phosphate buffered saline (PBS) pH 7.4 using Amicon Ultra centrifugal filter devices (Millipore, Billerica, Mass.), followed by protein concentration determination using a NanoDrop 2000 spectrophotometer (Thermo Scientific, Waltham, Mass.).

Although different antibody-cytokine fusion protein constructs were expressed in the HEK system with differing yields, several of them, in particular several of those based on IFNα, were produce at at least 100 mg/L of media, showed high solubility and did not aggregate as determined by size exclusion chromatography.

The amino acid sequences of the antibodies and antibody-ligand construct fusion protein constructs are described below. For antibody-cytokine fusion protein constructs in which the cytokine was fused to the C-terminus of the heavy or light chain, the following naming convention was used: [name of mab]-[linkage to heavy chain ("HC") or light chain ("LC")]-[Linker name]-[ligand name] [(mutation)] [isotype].

Thus for example the construct "Rituximab-HC-L6-IFNα (A145G) IgG1" is the antibody rituximab, with IFNα2b (with the A145G point mutation), linked to the C-terminus of the IgG1 heavy chain, with an intervening linker L6.

The linkers used in the experiments were as follows:
L0: no linker (direct fusion of the C-terminus of an antibody chain with the N-terminus of the cytokine)

L6: SGGGGS (SEQ ID NO: 132)

L16: SGGGGSGGGGSGGGGS (SEQ ID NO: 133)

Method for Measuring Antigen-Targeted Activity of Antibody-IFNα Fusion Protein Constructs "On target (Daudi) assay": This assay was used to quantify the anti-proliferative activity of IFNs and antibody-IFN fusion protein constructs on cells that display that antigen corresponding to the antibody to which the IFN is fused, and may be used as part of the assay for calculating the antigen-sensitivity index (ASI) defined herein. Daudi cells express both CD20 and CD38 as cell surface associated antigens. The viability of cells was measured using the reagent CellTiter-Glo®, Cat #G7570, from Promega (Madison, Wis.). This is a luminescence-based assay that determines the viability of cells in culture based on quantitation of ATP. The signal strength is proportional to the number of viable cells in a microtiter plate well. The details of the assay are as follows:

Daudi cells (obtained from ATCC, Manassas, Va.) were cultured in a T75 flask (TPP, Trasadingen, Switzerland, cat#90076) to a preferred density of between $0.5 \times 10^5$ and $0.8 \times 10^5$ viable cells/ml in RPMI 1640 (Mediatech, Inc., Manassas, Va., cat #10-040-CV) with 10% Fetal Bovine Serum (FBS; Hyclone, Logan, Utah cat# SH30070.03). Cells were harvested by centrifuging at 400 g for five minutes, decanting the supernatant, and resuspending the cell pellet in RPMI 1640+10% FBS. Cells were then counted and the density was adjusted to $3.0 \times 10^5$ cells/ml in RPMI 1640+10% FBS. Then, 50 µl of the cell suspension was aliquoted into each well of a 96 well round bottom tissue culture plate (hereafter, "experimental plate") (TPP, cat#92067). On a separate, sterile 96 well plate (hereafter, "dilution plate"; Costar, Corning, N.Y. cat#3879), test articles were serially diluted in duplicate in RPMI 1640+ 10% FBS. Then, 50 µl/well was transferred from the dilution plate to the experimental plate. The experimental plate was then incubated for four days at 37° C. with 5% $CO_2$.

A mixture of the manufacturer-supplied assay buffer and assay substrate (hereafter, "CellTiterGlo reagent", mixed according to the manufacturer's instructions) was added to the experimental plate at 100 µl/well. The plate was shaken for two minutes. Then, 100 µl/well was transferred from the experimental plate to a 96 well flat bottom white opaque plate (hereafter, "assay plate"; BD Biosciences, Franklin Lakes, N.J. cat#35 3296). The content of the assay plate was then allowed to stabilize in the dark for 15 minutes at room temperature. The plate was read on a Victor 3V Multilabel Counter (Perkin Elmer, Waltham, Mass., model#1420-041) on the luminometry channel and the luminescence was measured. Results are presented as "relative luminescence units (RLU)".

Data was analyzed using Prism 5 (Graphpad, San Diego, Calif.) using non-linear regression and three parameter curve fit to determine the midpoint of the curve (EC50). For each test article, potency relative to free IFNα2b (or some other form of IFN with a known potency relative to IFNα2b) was calculated as a ratio of EC50s.

One of ordinary skill in the art will appreciate that there are many other commonly used assays for measuring cell viability that could also be used.

"On target (ARP) assay" (also sometimes referred to herein as a "targeted assay"): The multiple myeloma cell line ARP-1 was a gift from Bart Barlogie MD, PhD, Director of the Myeloma Institute at the University of Arkansas Medical Center (Little Rock, Ak.). It is described in Hardin J. et al., (Interleukin-6 prevents dexamethasone-induced myeloma cell death. Blood; 84:3063, 1994). ARP-1 cells (CD38$^+$) were used to test CD38 targeting antibody-IFN fusion protein constructs. Culture and assay conditions were the same as for Daudi-based assay outlined above, with the following exceptions: ARP-1 was cultured to a density of $4.0 \times 10^5$ to $6.0 \times 10^5$ cells/ml. ARP-1 concentration was adjusted to $1.0 \times 10^4$ cells/ml prior to assay.

Method for Measuring Non-Antigen-Targeted Activity of Antibody-IFNα Fusion Protein Constructs "Off-target assay" (also sometimes referred to herein as the "not-targeted" assay): The iLite assay from PBL Interferon Source (Piscataway, N.J., Cat#51100), was performed largely as described by the manufacturer with the addition of a human IgG blocking step. The iLite cell line is described by the manufacturer as "a stable transfected cell line derived from a commercially available pro-monocytic human cell line characterized by the expression of MHC Class II antigens, in particular the human lymphocyte antigen (HLA-DR), on the cell surface." The cell line contains a stably transfected luciferase gene, the expression of which is driven by an interferon-response element (IRE), which allows for interferon activity to be quantified based on luminescence output. The manufacturer-supplied iLite plate (hereafter "assay plate") and diluent were removed from the −80° C. freezer and allowed to equilibrate to room temperature. Then, 50 µl of the diluent was added per well to the assay plate. The vial of manufacturer-supplied reporter cells was removed from the −80° C. freezer and thawed in a 37° C. water bath. Then, 25 µl aliquots of cells were dispensed into each well of the assay plate. Next, 12.5 µl of 8 mg/ml human IgG that was diluted into RPMI 1640+10% FBS (Sigma Chemicals, St. Louis, Mo.; cat# I4506) was added per well. The contents were mixed and incubated at 37° C. for 15 minutes. On a separate "dilution plate," test articles were serially diluted in duplicate in RPMI 1640+10% FBS. Then, 12.5 µl of the test articles were transferred from the dilution plate to the assay plate. The assay plate was then incubated at 37° C. with 5% $CO_2$ for 17 hours. The manufacturer-supplied assay buffer and substrate were removed from the −80° C. freezer and allowed to equilibrate to room temperature for two hours. The manufacturer-supplied assay buffer was added to the manufacturer-supplied substrate vial and mixed well according to the manufacturer's instructions to create the "luminescence solution." Then, 100 µl of the luminescence solution was added to each well of the assay plate. The plate was shaken for 2 minutes. The plate was then incubated at room temperature for 5 minutes in the dark and finally read on a Victor 3V Multilabel Counter on a luminometry channel and the luminescence measured and presented as RLU. The data was analyzed with Graphpad Prism 5 as described for the "on-target (Daudi) assay," above. To test anti-CD38 antibody-IFN fusion protein constructs in the iLite assay, the manufacturer-supplied diluent was supplemented with 2 mg/ml human IgG and 0.5 mg/ml anti-CD38 antibody (same antibody clone being tested as an antibody-IFN fusion protein construct, to block any binding of the anti-CD38 antibody-IFN fusion protein constructs to the CD38 expressed on the iLite cells).

Results: Antigen-Specificity of Antibody-IFNα Fusion Protein Constructs

Figure 6:
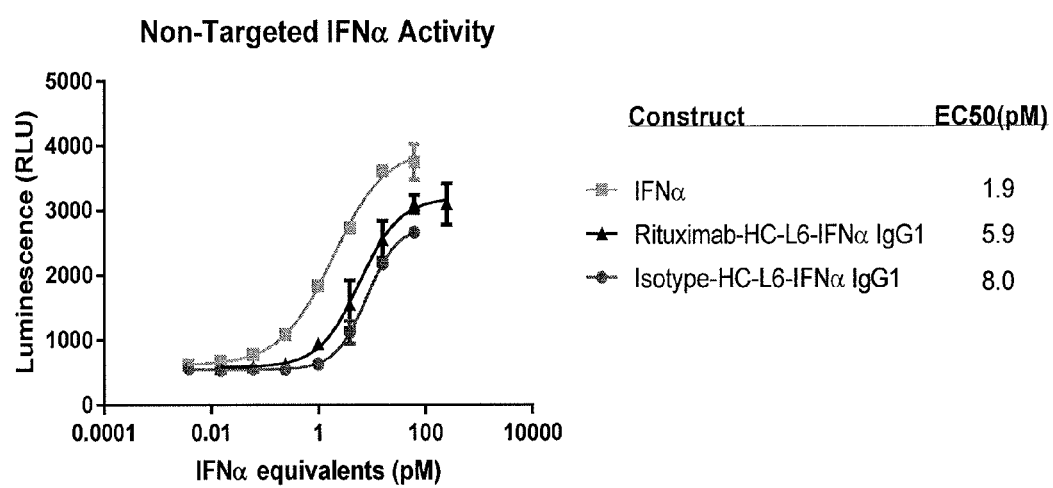
FIG. 6 shows the non-antibody-antigen-targeted interferon activity of IFNα2b, and of the antibody-IFN fusion protein constructs Rituximab-IFNα2b (Rituximab-HC-L6-IFNα IgG1) and Palivizumab-IFNα2b (Isotype-HC-L6-IFNα IgG1) in the interferon activity assay described in the examples below as the "off-target assay. Throughout the figures "IFNα equivalents" refers to the molar concentration of interferon molecules, either free or attached to an antibody. "IFN" refers to free (non-fusion protein) wild-type interferon.

FIG. 6 shows the interferon activity of free IFNα2b (SEQ ID NO:3; "IFNα" in figure) as well as IFNα2b fused to the C-terminus of the heavy chain of two different antibodies (rituximab and palivizumab, an isotype control antibody), as acting on a the iLite cell line. This cell line does not display the antigen for either of these antibodies, so this assay reveals the potency of various IFNα2b-containing proteins in the absence of antibody-antigen-based targeting. The details of this assay are described above under the heading "Method for measuring non-antigen-targeted activity of antibody-IFNα fusion protein constructs" and is hereafter abbreviated as the "off-target assay." "Rituximab-HC-L6-IFNα IgG1" refers to the CD20-targeting chimeric antibody Rituximab, in which the light chain (SEQ ID NO:276) is unaltered but the IgG1 class heavy chain (SEQ ID NO:277) has, attached to its C terminus, a 6 amino acid linker sequence ("L6;" SGGGGS, SEQ ID NO:132), followed by the sequence for IFNα2b (SEQ ID NO:3); this heavy chain-linker-IFNα sequence is shown as SEQ ID NO:280. "Isotype-HC-L6-IFNα IgG1" refers to the RSV-targeting humanized antibody Palivizumab, in which the light chain (SEQ ID NO:290) is unaltered but the IgG1 class heavy chain (SEQ ID NO:291) has, attached to its C terminus, a 6 amino acid linker sequence ("L6;" SGGGGS, SEQ ID NO:132), followed by the sequence for IFNα2b (SEQ ID NO:3); this heavy chain-linker-IFNα2b sequence is shown as SEQ ID NO:294. In this assay, free IFNα2b showed an $EC_{50}$ for activating gene expression through an interferon response element (IRE) of 1.9 pM. By attaching IFNα2b to Rituximab, there was a 3.1-fold (5.9/1.9=3.1) decrease in its potency. A similar, modest decrease in potency was observed when IFNα2b was linked to Palivizumab. Again, the cell line used in this study did not have the antigen corresponding to either of these antibodies on its cell surface, demonstrating that attachment of an IgG to the N-terminus of IFNα2b caused a modest (3-4×) decrease in its non-antigen-targeted IFN activity. This is consistent with what has been reported by other (for example in U.S. Pat. No. 7,456,257). Neither Palivizumab nor Rituximab alone (without the fusion to an interferon) showed any activity in this assay (data not shown).

Figure 7:
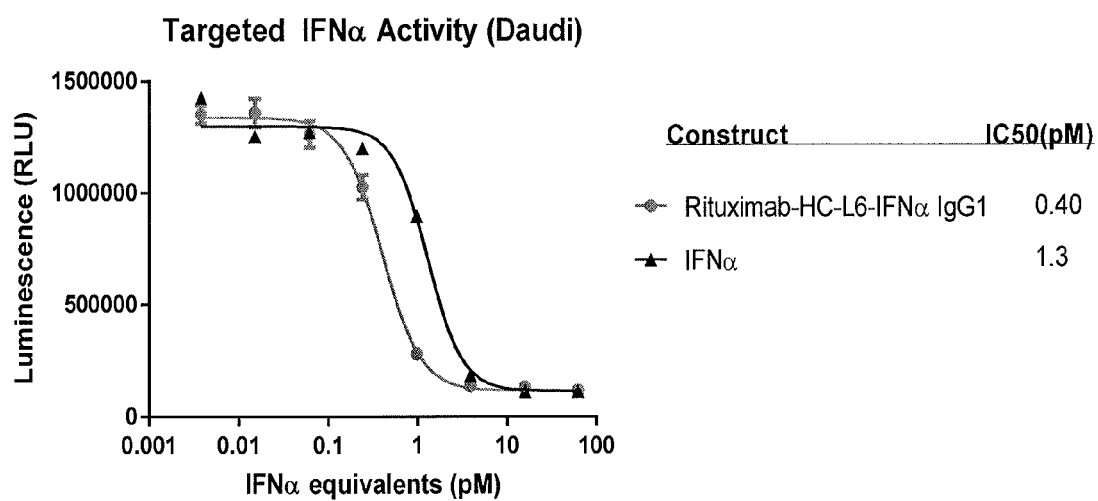
FIG. 7 shows the antibody-antigen-targeted interferon activity of the Rituximab-IFNα2b fusion protein construct (Rituximab-HC-L6-IFNα IgG1) compared with IFNα2b in the antiproliferative assay described in the examples below as the "on target (Daudi) assay."

To determine whether the antibody-IFNα2b fusion protein constructs had enhanced activity relative to free IFNα2b on cells that do display the corresponding antigen on their cell surface, their effect on Daudi cells, which display the CD20 antigen of Rituximab, but which do not display the RSV F protein antigen corresponding to Palivizumab, was examined. The assay used in this case, described above as "Method for measuring antigen-targeted activity of antibody-IFNα fusion protein constructs" or simply the "on-target (Daudi) assay," measured the effect of the test substances on the viability of Daudi cells. With these cells, the Rituximab-IFNα2b fusion protein construct (Rituximab-HC-L6-IFNα IgG1) was 3.25-fold (1.3/0.4=3.25) more potent than free IFNα2b (FIG. 7). In other words, the attachment of Rituximab to IFNα2b resulted in slightly reduced (3.1-fold) activity towards antigen-negative cells (FIG. 6) but slightly increased (3.25-fold) activity towards antigen-positive cells (FIG. 7). Overall, the antibody attachment therefore increased the antigen-specificity index (ASI), defined as the fold increased potency relative to free IFNα2b on antigen-positive cells multiplied by the fold decreased potency relative to free IFNα2b on antigen-negative cells, by 10-fold (3.1×3.25) in this experiment. A repeat of the experiments measured an ASI of 14, as shown in Table 20, row 2. The EC50 (mathematical midpoint of the dose-response curve) was used as a measure of potency in the calculations presented here. In other words, when compound A showed an EC50 that is 10-fold lower than compound B, it was said to have a 10-fold higher potency.

Figure 8:
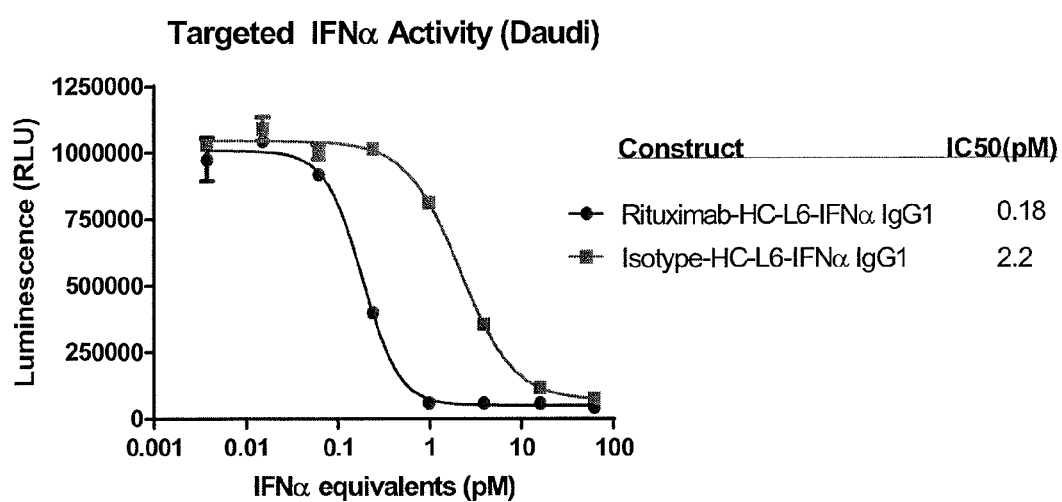
FIG. 8 shows the antibody-antigen-targeted interferon activity of the Rituximab-IFNα fusion protein construct (Rituximab-HC-L6-IFNα IgG1) compared with the non-targeted activity of Palivizumab-IFNα fusion protein construct (Isotype-HC-L6-IFNα IgG1) in the "on-target (Daudi) assay" described in the examples below.

The results presented in FIG. 8 are consistent with antibody-based targeting relying on antibody-antigen reactivity: the Rituximab-IFNα fusion protein construct (Rituximab-HC-L6-IFNα-IgG1) was 12-fold (2.2/0.18=12) more potent in reducing viability of the $CD20^+$ Daudi cells than the Palivizumab-IFNα fusion protein construct (Isotype-HC-L6-IFNα-IgG1), the antigen for which is not present on the Daudi cells.

The modest reduction in IFNα activity that occurred as a result of linking it to an antibody may not be sufficient to prevent the toxicity of the IFNα component of the construct in human subjects. Various mutations were therefore introduced into IFNα2b in order to reduce its activity and toxicity. For example, five different mutant versions of IFNα2b were generated and, in each case, linked to the C-terminus of the heavy chain of Rituximab via the six amino acid linker L6, which has the sequence SGGGGS (SEQ ID NO:132). These constructs were compared to the Rituximab-wild type IFN fusion protein construct, Rituximab-HC-L6-IFNα IgG1 (as also used in the experiments shown in FIGS. 6-8). The five mutant versions were R144A, A145G, R33A+YNS, R33A and R144A+YNS. The sequences of these variants are described below. The degree of expected reduced affinity for the type I interferon receptors based on previous characterization by others of IFN mutants, and the amount of expected attenuation in interferon activity, are shown in Tables 6 and 7, above.

Figure 9:
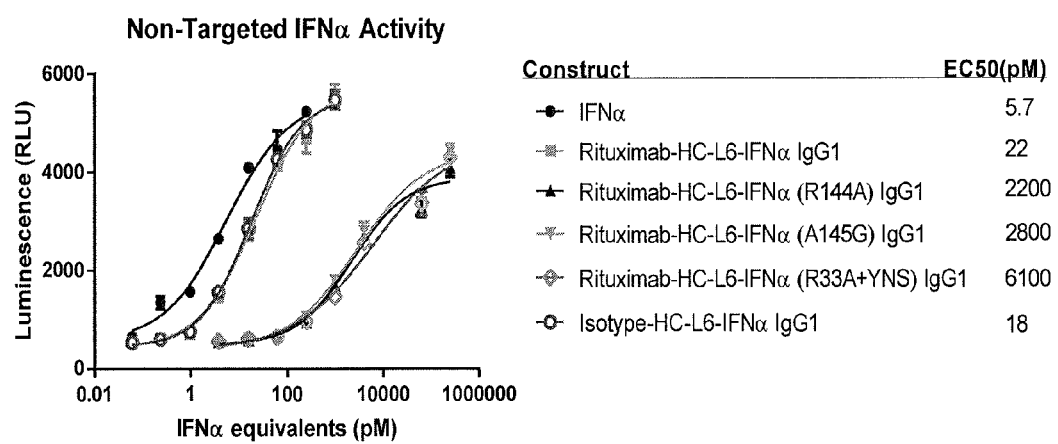
FIG. 9 shows the non-antibody-antigen-targeted interferon activity of IFNα2b, of the antibody-IFN fusion protein constructs Rituximab-IFNα2b (Rituximab-HC-L6-IFNα IgG1) and Palivizumab-IFNα2b (Isotype-HC-L6-IFNα IgG1), and of certain variants of Rituximab-IFNα2b constructs that have been mutated to reduce their interferon activity. The assay is described in the examples as the "off-target assay".
Figure 10:
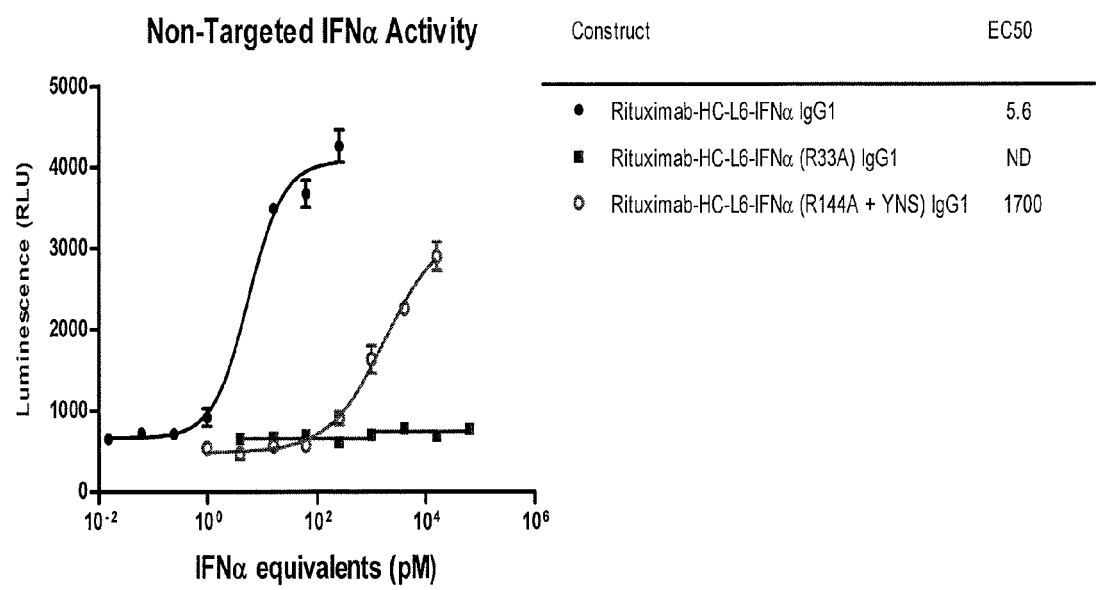
FIG. 10 shows the non-antibody-antigen-targeted interferon activity of the antibody-IFN fusion protein constructs Rituximab-IFNα2b (Rituximab-HC-L6-IFNα IgG1) and of two variants of Rituximab-IFNα2b that were mutated to reduce interferon activity. The assay is described in the examples as the "off-target assay".
Figure 11:
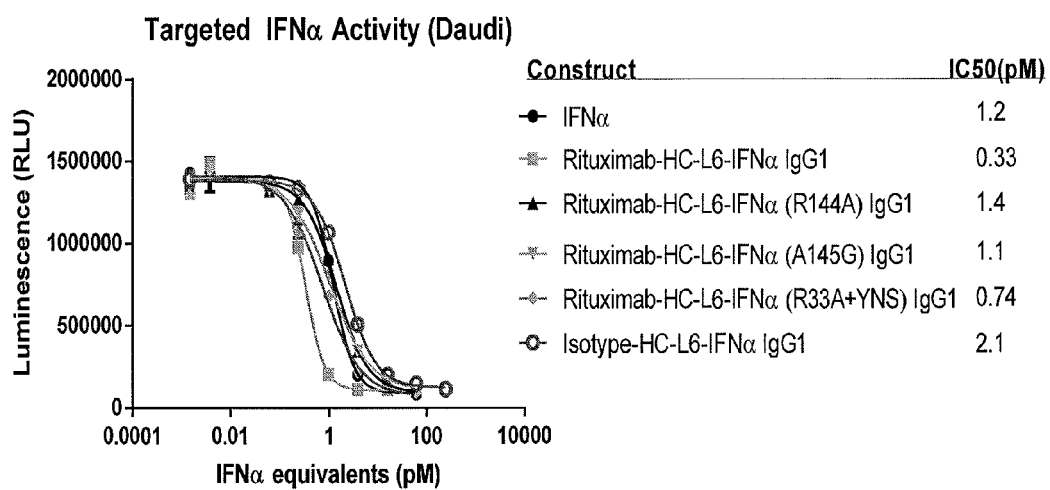
FIG. 11 shows the antibody-antigen-targeted interferon activity of the antibody-IFN fusion protein construct Rituximab-IFNα2b (Rituximab-HC-L6-IFNα IgG1) and of variants of Rituximab-IFNα2b constructs that have been mutated to reduce their interferon activity compared to the non-targeted activity of the Palivizumab-IFNα2b (Isotype-HC-L6-IFNα IgG1) fusion protein constructs and compared to IFNα2b. The assay is described in the examples as the "on target (Daudi) assay."
Figure 12:
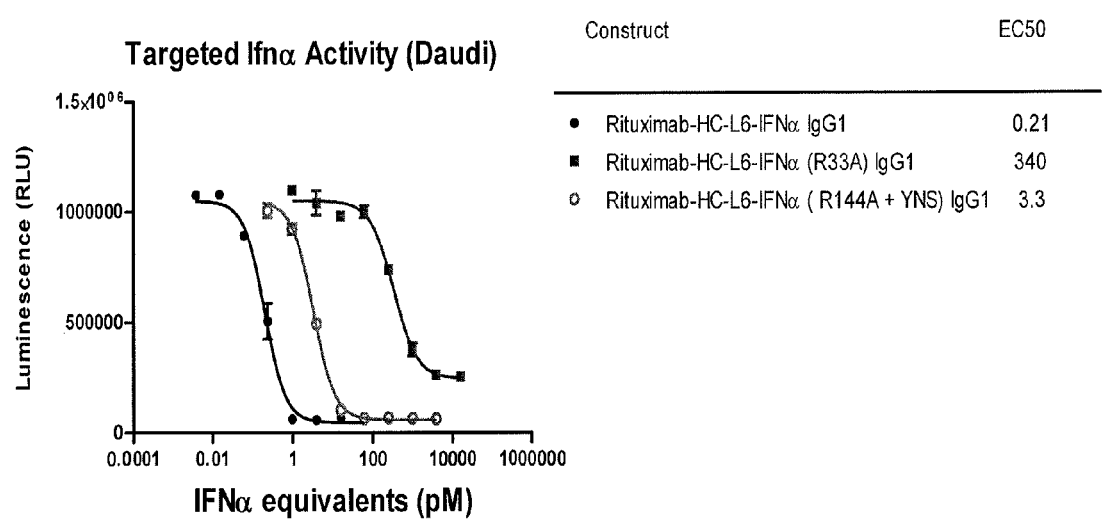
FIG. 12 shows the antibody-antigen-targeted interferon activity of the antibody-IFN fusion protein constructs Rituximab-IFNα2b (Rituximab-HC-L6-IFNα IgG1) and of two variants that were mutated to reduce interferon activity. The assay is described in the examples as the "on target (Daudi) assay."

FIGS. 9, 10 and Table 20 show the degree of reduced interferon activity for each of these Rituximab-attenuated IFNα2b fusion protein constructs relative to free, wild type IFNα2b, on antigen-negative (i.e. CD20-negative) cells. The R144A mutant of the Rituximab-IFNα2b fusion protein construct (composed of SEQ ID NOS:282 (heavy chain) and 276 (light chain)) showed 386-fold reduced interferon activity (2200/5.7=386). The A145G and R33A+YNS versions (composed of the heavy chains of SEQ ID NOS:284 and 286, respectively, each of which are combined with the light chain of SEQ ID NO:276) showed 491-fold (2800/5.7=491) and 1,071-fold (6100/5.7=1,071) reduced activity, respectively. FIG. 10 shows the degree of reduced interferon activity for the R144A+YNS fusion protein construct (composed of SEQ ID NOS:288 (heavy chain) and 276 (light chain)) to be 303-fold (1700/5.6=303) relative to the Rituximab fusion protein construct lacking the IFN mutations (Rituximab-HC-L6-IFNα IgG1); since Rituximab-HC-L6-IFNα IgG1 is 3.8-fold less potent on antigen negative cells than free, wild type IFNα2b (data from FIG. 9; 22/5.7=3.8), this means that the R144A+YNS version of the fusion protein construct was 1,150-fold less potent than free, wild type IFNα (303×3.8=1,150). The R33A version of the fusion protein construct (composed of SEQ ID NOS:436 (heavy chain) and 276 (light chain)) was attenuated to such a high degree that it showed no detectable activity in the non-targeted assay.

activity on antigen-positive cells (FIGS. 11 and 12) relative to their reduced potency on antigen-negative cells (FIGS. 9 and 10). With the exception of the R33A version of the fusion protein construct, discussed below, the attenuating mutations caused a 384-1,160-fold decrease in interferon activity relative to free wild type IFNα2b on antigen-negative cells, but showed 0.23-1.2-fold of the potency of wild type IFNα2b on antigen-positive cells. The R33A mutated fusion protein construct, which had undetectable IFN activity in the absence of antibody-antigen targeting, still showed significant activity in the presence of antibody-targeting; the potency of the R33A version of the fusion protein construct was 1,620-fold lower than the same fusion protein construct lacking this attenuating mutation in the on-target assay (340/0.21=1,620-fold attenuation). This is in stark contrast to the at least 100,000-fold attenuation caused by the same mutation in the absence of antibody-based targeting (FIG. 10). These results are summarized in Table 20.

To determine whether this dramatic difference in the ability of the mutations in the IFNα component of the fusion

TABLE 20

| Fusion protein construct Test Article | Targeted Potency Relative to free IFNα2b (EC50 IFNα2b/EC50 Fusion protein construct) Column A | Non-Targeted Potency Relative to free IFNα2b (EC50 IFNα2b/EC50 Fusion protein construct) Column B | Antigen-Specificity Index (ASI; calculated as Column A/ Column B) |
|---|---|---|---|
| Ritux-IFNα2b | 3.6 | 0.26 | 14 |
| Ritux-IFNα2b (R144A) | 0.86 | 0.0026 | 330 |
| Ritux-IFNα2b (A145G) | 1.2 | 0.0020 | 600 |
| Ritux-IFNα2b (R33A + YNS) | 1.6 | 0.00093 | 1,700 |
| Ritux-IFNα2b (R33A) | 0.0022* | No detectable activity in non-targeted assay | ND |
| Ritux-IFNα2b (R144A + YNS) | 0.23* | 0.00086* | 270 |

*Free IFNα2b was not tested on the same day as the test articles in these rows. Therefore, these measurements are based on a comparison of the test article with Rituximab-HC-L6-IFNα IgG1, which was assayed on the same day and same plate, multiplied by a correction factor based on the relative activity of IFNα2b vs Rituximab-HC-L6-IFNα IgG1 (i.e. data shown in the second row from the top) measured on a different day.

Surprisingly, when the amount of interferon activity of these highly attenuated rituxumab-mutant IFNα2b fusion protein constructs was measured on antigen-positive cells (Daudi, CD20+), there was generally very little attenuation compared to the wild type IFNα2b version of the Rituximab-IFNα2b fusion protein construct (FIGS. 11-12), and thus the mutated interferons still possessed the ability to activate the IFN receptor on "on-target" cells whilst having a greatly reduced ability to activate it on "off-target" cells. For example, the R33A+YNS version of the construct was only 2.2-fold (0.74/0.33=2.2) less active than the Rituximab-IFNα2b wild type construct on the antigen-positive (Daudi) cells. This was in contrast to the 277-fold (6100/22=277; FIG. 9) reduced activity on antigen-negative cells. The mutations in the IFNα2b, in the context of the Rituximab-IFNα2b fusion protein construct, caused a substantially greater attenuation of activity on antigen-negative cells than on antigen-positive cells. As a result, the Rituximab-HC-L6-IFNα2b (R33A+YNS) IgG1 fusion protein construct exhibited a substantially greater antigen-specificity index (ASI, 1,700-fold) compared to Rituximab-HC-L6-IFNα2b IgG1 (10- to 14-fold) or free IFNα2b (1-fold, by definition), suggesting that its off-target effects in vivo will be substantially reduced.

Other Rituximab-IFNα2b constructs with mutations in the IFNα2b portion also showed surprisingly little reduced protein constructs to substantially reduce its activity on antigen-negative cells as compared to antigen-positive cells could be extended to other fusion protein constructs targeting other antigens, antibodies targeting the multiple myeloma antigen CD 38 (SEQ ID NO:131) were fused to both wild type and attenuated forms of IFNα and characterized. Some of these experiments were performed using the antibody G005 (De Weers et al. (U.S. Pat. No. 7,829, 673)); the sequences of the heavy and light chains for this human antibody are shown as SEQ ID NOS:135 and 134, respectively.

In addition, several novel human and rat antibodies against CD38 were produced, as described below.
Development of Novel CD38 Antibodies
Formatting CD38 Constructs for Expression The extracellular domains (ECD) of human and cynomolgus monkey CD38 proteins were each formatted to include a cleavable N-terminal leader sequence, an Avitag™, a poly-histidine tag and a thrombin cleavage site to yield proteins SEQ ID NO:127 and 128 respectively. These were back-translated into DNA sequences and synthesized de novo by assembly of synthetic oligonucleotides by methods known by those with skill in the art. Following gene synthesis, the genes were subcloned into vector pTT5 (Durocher, Nucleic Acids Research volume 30, number 2, pages E1-9, 2002) to yield constructs to produce soluble secreted forms of these proteins via transient expression in HEK293E cells (Durocher, supra).

Construction of Vectors for Antibody Expression

Heavy and light chain variable region sequences were subcloned into variants of the vector pTT5 containing either a human IgG1 heavy chain constant region (such as Swissprot accession number P01857), a human IgG4 heavy chain constant region (such as Swissprot accession number P01861 incorporating substitution S228P), human kappa constant region (Swissprot accession number P01834) or human lambda region (Swissprot accession number P0CG05) to yield full length antibody chains.

Transient Expression of Constructs in HEK293-6E Cells

HEK293-6E cells were cultured in complete cell growth media (1 L of F17 medium (Invitrogen™), 9 mL of Pluronic F68 (Invitrogen™), 2 mM Glutamine containing 20% (w/v) Tryptone NI (Organotechnie®) with Geneticin (50 mg/mL, Invitrogen™) at 50 µl/100 mL culture). The day before transfection, cells were harvested by centrifugation and resuspended in fresh media (without Geneticin). The next day DNA was mixed with a commercial transfection reagent and the DNA transfection mix added to the culture dropwise. The culture was incubated overnight at 37° C. with 5% $CO_2$ and 120 rpm without Geneticin. The next day, 12.5 mL of Tryptone was added along with 250 µl of Geneticin per 500 mL culture. The culture was incubated at 37° C., 5% $CO_2$ and 120 rpm. After 7 days, the supernatant was harvested by centrifugation and was ready for purification.

Expression and Purification of Antibodies

Transient co-expression of heavy and light chains in HEK293-6E cells (as described above) generated antibodies that were subsequently purified by protein A chromatography. Briefly, supernatants derived from these transfections were adjusted to pH 7.4 before being loaded onto a HiTrap Protein A column (5 mL, GE Healthcare). The column was washed with 50 mL of 1×PBS (pH 7.4). Elution was performed using 0.1 M citric acid pH 2.5. The eluted antibody was desalted using Zeba Desalting columns (Pierce) into 1×PBS (pH 7.4). The antibodies were analyzed using SDS-PAGE. The concentration of the antibody was determined using the BCA assay kit (Pierce).

Purification of Histidine-Tagged Proteins from Tissue Culture Supernatants

Immobilized metal ion affinity chromatography (IMAC) was used to purify human and cynomolgous monkey CD38 extracellular domain (ED) proteins from tissue culture supernatants. Briefly, protein supernatants were diluted in binding buffer (20 mM sodium phosphate, 0.5 M NaCl, 30 mM imidazole, pH 7.4) before being loaded onto a HisTrap™ FF column (1 mL, GE Healthcare). The column was washed with 5 mL of binding buffer (pH 7.4) and elution was performed using 20 mM sodium phosphate, 0.5 M NaCl, 500 mM imidazole, pH 7.4. The eluted proteins were desalted and buffer exchanged using Amicon Ultra-15 centrifugal filter unit with Ultracel-10 membrane (Millipore) into 1×PBS (pH 7.4). The absorbance at 280 nm ($A_{280}$) of the protein was assessed using a Nanodrop spectrophotometer and readings corrected using the predicted extinction coefficients to determine protein concentrations.

Biotinylation of Antigens for Phage Display

The Avitag™ motifs of human and cynomolgus monkey CD38 EDs were biotinylated according to manufacturer's directions (Avidity LLC, Aurora, Colo.). Excess unconjugated biotin was removed from the biotinylated proteins by desalting into 1×PBS using a 7 KD molecular weight cut off (MWCO) Zeba spin column (Thermo Scientific, Logan, Utah) according to manufacturer's instructions. Successful biotinylation of CD38 ED proteins was confirmed using a combination of polyacrylamide gel electrophoresis and Western blotting. Western blots were probed using Streptavidin-HRP (BD Biosciences, San Diego, Calif.) and developed using TMB (Sigma-Aldrich, St. Louis, Mo.). For each antigen, monomeric biotinylated CD38 ED was detected.

Generation of Anti-CD38 Antibodies by Phage Display

FAbs that bind to both human and cynomolgus monkey CD38 EDs were isolated from a naïve phagemid library comprising approximately $2.5\times10^{11}$ individual human FAb fragments. Methods of generating phage antibody fragment libraries are discussed in "Phage display: A Practical Approach" (Eds. Clackson and Lowman; Oxford University Press, Oxford, UK) and "Antibody Phage Display Methods and Protocols" (Eds. O'Brien and Aitken; Humana Press Inc, NJ 07512). Briefly, antibody heavy and light chain variable regions were amplified based on RNA from donor samples. Antibody heavy and light chain variable regions were then inserted into phagemid vectors to generate a library of antibody fragments fused to a phage coat protein. The antibody library used herein was a high diversity naïve phagemid library that expressed antibody fragments in the Fab format.

Anti-CD38 FAbs were isolated from the phage display library over the course of two panning 'campaigns' (i.e. discrete phage display experiments with different reagents or panning conditions). The general protocol followed the method outlined by Marks et al. (Marks, J. D. & Bradbury, A., 2004, Methods Mol Biol, 248, 161-76).

Each phage display campaign involved three rounds of panning. For each round, ~$2.5\times10^{12}$ phage particles were blocked by mixing 1:1 with blocking buffer (4% skim milk in PBS, pH 7.4) and incubating for 1 hr at room temperature. The blocked phage library was then pre-depleted for any biotinylated protein tag motif binders used in panning through incubation for 45 mins with 50-200 pmols of an irrelevant antigen containing an identical biotinylated tag motif. Tag- and streptavidin-binders were captured by adding an excess (75-300 µL) of streptavidin-coated Dynabeads (Invitrogen), which were blocked as described for the library. The beads (including tag- and streptavidin-binders attached to them) were immobilized using a magnet and discarded.

Library panning was conducted by mixing the blocked and pre-depleted library with 50-200 pmols of biotinylated recombinant CD38 ED in a 2 mL microcentrifuge tube and rotating for 2 hrs at room temperature. Then, 100 µL of streptavidin-coupled Dynabeads (Invitrogen, Carlsbad, Calif.) were added and the mixture was incubated a further 15 minutes as described previously. Non-specifically bound phage were removed using a series of washes. Each wash involved pulling the bead complexes out of the solution onto the tube wall using a magnetic rack, aspirating the supernatant and then re-suspending the beads in fresh wash buffer. This was repeated multiple times with either PBS wash buffer (1×PBS with 0.5% skim milk) or PBS-T wash buffer (1×PBS supplemented with 0.05% TWEEN-20 [Sigma-Aldrich, St. Louis, Mo.] and 0.5% skim milk). Phage that remained bound after the washing process were eluted from the biotinylated-CD38 ED-bead complexes by incubation with either a twenty-fold excess of non-biotinylated CD38 ED for 1 hr at room temperature or 0.5 mL of 100 mM triethylamine (TEA) (Merck Chemicals, Darmstadt) for 20 mins at room temperature. TEA-eluted 'output' phage were neutralized by the addition of 0.25 mL of 1 M Tris-HCl pH 7.4 (Sigma-Aldrich, St. Louis, Mo.).

At the end of the first and second rounds of panning, the output phage were added to a 10 mL culture of exponentially growing TG1 E. coli (2× yeast-tryptone (2YT) growth media) and allowed to infect the cells during a 30 minute incubation at 37° C. without shaking, then with shaking at 250 rpm for 30 additional minutes. The phagemids encoding the phage display output were then rescued as phage particles following a standard protocol (Marks, J. D. & Bradbury, A., 2004, Methods Mol Biol, 248, 161-76). At the end of the third panning round, TG1 cells were infected with output phage and were plated on 2YT agar (supplemented with 2% glucose and 100 µg/mL carbenicillin) at a sufficient dilution to produce discrete E. coli colonies. These colonies were used to inoculate 1 mL liquid cultures to allow expression of FAb fragments for use in screening experiments.

ELISA-Based Screening of FAbs for CD38 Binding

Each individual E. coli colony was used to express a FAb that could be screened for CD38 ED-binding activity. Colonies were inoculated into 1 mL starter cultures (supplemented with 100 µg/mL carbenicillin and 2% glucose) in 96-well deep-well plates (Costar) and incubated overnight at 37° C. with shaking at 350 rpm (Innova R44 shaker; 1 inch orbit). These starter cultures were diluted 1:100 into a 1 mL expression culture (2YT supplemented with 100 µg/mL carbenicillin) and grown to an optical density (600 nm) of 0.5-0.8. FAb expression was induced by adding isopropyl-beta-D-thiogalactopyranoside (IPTG) to a final concentration of 1 mM. Cultures were incubated at 25° C. for 16 hrs.

FAb samples were prepared by harvesting cells by centrifugation (2,000 g, 10 mins) and performing a lysozyme extraction. The cell pellet was resuspended in 200 µL of lysis buffer (160 µg/mL lysozyme, 10 µg/mL RNase A, 5 µg/mL DNase and complete protease inhibitors (Roche, Nutley, N.J.)) and shaken at 400 rpm for 30 minutes at 21° C. Following addition of a further 100 µl of lysis buffer, the reactions were incubated for a further 30 minutes as described previously. Clarified lysates were isolated following centrifugation at 3,000 g for 10 minutes and stored at 4° C. until required.

To screen by enzyme-linked immunosorbent assay (ELISA) for human CD38 ED-binders derived from the phage display biopanning, human CD38 extracellular domain (ED) (produced in HEK 293-6E cells and biotinylated as described above) was captured on streptavidin-coated ELISA plates (Nunc) at 1 µg/mL. Plates were then washed and individual FAb samples (prepared as described above) were added to individual wells on the ELISA plates. FAbs were allowed to bind the captured CD38 ED for an hour at room temperature and then washed three times with PBS-T (1×PBS supplemented with 0.1% Tween®20). FAbs that bound to CD38 ED were detected by incubation for 30 minutes at room temperature with an anti-V5-HRP conjugated antibody (Invitrogen, Carlsbad, Calif.) to detect the V5 tag fused to the C-terminus of the FAb heavy chain. Plates were washed to remove unbound antibody and the assay signal developed by incubation with 50 µL 3,3',5,5'-Tetramethylbenzidine (Sigma-Adrich, St. Louis, Mo.) and quenching with 50 µL 1 M HCl. Assay signals were read at A450 nm using a microplate reader (BMG Labtech). Results were expressed as the raw A450 nm value, where any signal 2-fold greater than the average assay background was defined as 'positive'.

In later assays FAb cross-reactivity with cynomolgus monkey CD38 ED was assessed by coating biotinylated cynomolgus monkey CD38 ED onto streptavidin coated ELISA plates and proceeding as described above. Plasmids encoding FAbs cross-reactive with both human and cynomolgus monkey CD38 ED were isolated and sequenced. Of approximately 1,000 FAbs screened for binding to human and cynomolgus monkey CD38 ED, six genetically unique FAbs were identified. Table 21 summarises the FAb sequence data obtained. The variable regions of some of these antibodies are shown in FIG. 13.

TABLE 21

| Campaign Number | FAb name | $V_H$ sequence | $V_K/V_L$ sequence |
| --- | --- | --- | --- |
| 1 | X910/12 | SEQ ID NO: 395 | SEQ ID NO: 394 |
| 1 | X913/15 | SEQ ID NO: 397 | SEQ ID NO: 396 |
| 2 | X355/01 | SEQ ID NO: 421 | SEQ ID NO: 420 |
| 2 | X355/02 | SEQ ID NO: 391 | SEQ ID NO: 390 |
| 2 | X355/04 | SEQ ID NO: 423 | SEQ ID NO: 422 |
| 2 | X355/07 | SEQ ID NO: 393 | SEQ ID NO: 392 |

All FAbs were converted into IgG1 format by cloning into the pTT5 vectors (described above), expressed in HEK293-6E cells and the resulting IgGs purified by protein A affinity chromatography as described above.

Assessing Binding of IgGs to Human CD38 Positive Cell Line RPMI-8226

Figure 14:
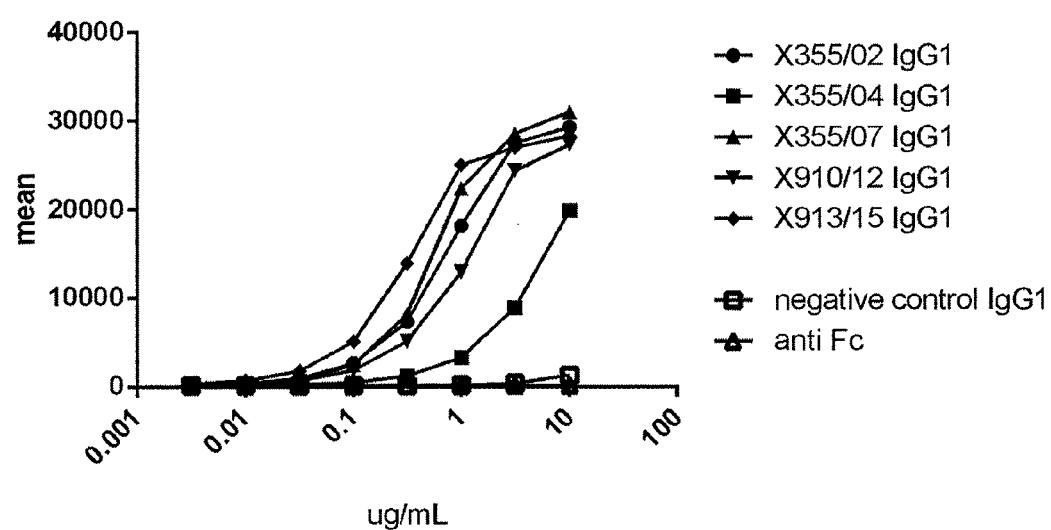
FIG. 14 shows the results of detection of binding of novel human anti-CD38 antibodies to a CD38+ cell line RPMI-8226 by flow cytometry. The x axis is the antibody concentration in micrograms/ml and the y axis represents the mean fluorescence intensity.

The ability of the phage derived antibodies to bind the model human CD38 positive myeloma cell line RPMI-8226 (obtained from the Health Protection Agency Culture Collections, Porton Down, Salisbury, SP4 0JG, UK) in flow cytometry-based assays was tested. Briefly, viable RPMI-8226 cells (2×10$^5$, as judged by trypan blue exclusion) were incubated with each antibody or with a human IgG$_1$ isotype control antibody preparation (Sigma-Aldrich, St. Louis, Mo.) at various concentrations in 100 µl of FACS buffer (PBS plus 1% fetal calf serum, FCS) in 96 well plates for 20 minutes on ice in the dark. Cells were washed twice with FACS buffer before incubation for 20 minutes in 100 µl of FACS buffer containing goat anti-human IgG (Fc-specific, conjugated to fluorescein isothiocyanate, FITC; Sigma-Aldrich, St. Louis, Mo.). After washing with FACS buffer, cells were resuspended in FACS buffer and analysed for antibody binding by flow cytometry on a FACS Canto (BD Biosciences, San Diego, Calif.) using EV, side scatter and FL-1 gating. Results are expressed as mean fluorescent intensity (MFI) plotted against protein concentration (FIG. 14).

Generation of Anti-CD38 Antibodies by Genetic Immunization

Monoclonal antibodies against human CD38 ED were generated by genetic immunization with corresponding conventional protein immunization of rats. For genetic immunization, the DNA sequence of human CD38 ED is provided in SEQ ID NO:129. The corresponding conceptually translated protein sequence is given in SEQ ID NO:130. The DNA sequence of SEQ ID NO:129 was cloned into a plasmid for genetic immunization using restriction enzyme technology. Expression of the resulting plasmid allowed the secretion of soluble CD38 ED tagged by a c-myc epitope at the N- or C-terminus. The c-myc epitope was utilized to confirm expression of CD38 ED.

Rats were then immunized six times with the plasmid using a Helios gene gun (Bio-Rad, Germany) according to a published procedure (Kilpatrick et al., Hybridoma 17: 569-576, 1998). One week after the last application of the immunization plasmid, each rat was boosted by intradermal injection of untagged recombinant human CD38 ED. Untagged human CD38 ED for this purpose was produced by removing the protein tags from SEQ ID NO:127 by thrombin cleavage followed by purification over a size exclusion column.

Four days later, the rats were sacrificed and their lymphocytes fused with myeloma cells using polyethylene glycol (HybriMax™; Sigma-Aldrich, Germany), seeded at 100,000 cells per well in 96-well microtiter plates and grown in DMEM medium supplemented with 10% fetal bovine serum and HAT additive for hybridoma selection (Kilpatrick et al., 1998, supra).

Screening Hybridoma Supernatants for Human and Cynomolgus Monkey CD-38 Cross-Reactivity Duplicate 100 µL samples of each hybridoma supernatant were coated onto separate wells of a maxisorp ELISA plate (Nunc Plasticware, Thermo Scientific, Rochester, N.Y. 14625, USA) through incubation at room temperature for an hour. Plates were washed three times in 1×PBS-T and subsequently blocked by addition of 2% BSA/1×PBS. Following incubation for 1 hour at room temperature, plates were washed as described previously. To one well of each rat antibody duplicate well was added 0.1 µg of biotinylated human CD38 in a final volume of 100 µL, 1×PBS. To the second well of each rat antibody duplicate well was added 0.1 µg of biotinylated cynomolgus monkey CD38 ED in a final volume of 100 µL 1×PBS. Plate wells were washed as described previously prior to detection of bound biotinylated CD38 ED using a Streptavidin-HRP conjugate (BD Biosciences, San Diego, Calif.). Plates were washed as above to remove unbound Streptavidin-HRP conjugate and the assay signal developed by incubation with 50 µL 3,3',5,5'-Tetramethylbenzidine (Sigma-Aldrich) and quenching with 50 µL 1 M HCl. Assay signals were read at $A_{450}$ nm using a microplate reader (BMG Labtech, Cary, N.C.). Of the 15 hybridoma supernatants tested, all fifteen bound human CD38 ED and seven bound cynomolgus monkey CD38 ED (Table 22) as determined by ELISA. The cross-reactive antibodies are referred to as R5D1, R7F11, R5E8, R10A2, R10B10, R3A6 and R7H11.

Flow Cytometry Binding of Rat Antibodies to Human CD38 Positive Cell Line RPMI-8226

Viable RPMI-8226 cells ($2 \times 10^5$, as judged by trypan blue exclusion) were incubated with 100 µL of rat hybridoma supernatant for 20 minutes on ice in the dark. Cells were washed twice with FACS buffer (1×PBS plus 1% FCS) before incubation for 20 minutes in 100 µl of FACS buffer containing anti-rat IgG-FITC conjugate (Sigma-Aldrich). After washing cells in FACS buffer, they were resuspended in FACS buffer and analysed for antibody-binding by flow cytometry on a FACS Canto (BD Biosciences, San Diego, Calif.) using EV, side scatter and FL-1 gating. Results were expressed as mean fluorescent intensity (MFI). Of the 15 rat antibodies exhibiting positive binding to human CD38 ED by ELISA, five showed weak or negligible binding to CD38 expressed on the human myeloma cell line RPMI-8226 by FACS (Table 22).

TABLE 22

| Rat antibody | Binding to Human CD38 ED (ELISA) | Binding to Cynomolgus monkey CD38 ED (ELISA) | FACS binding to RPMI-8226 cells (MFI) |
| --- | --- | --- | --- |
| R3A6 | Y | Y | 279 |
| R5D1 | Y | Y | 12207 |
| R5E8 | Y | Y | 10618 |
| R7F4 | Y | N | 310 |
| R7F11 | Y | Y | 11897 |
| R7H11 | Y | Y | 680 |
| R8A7 | Y | N | 5994 |
| R9B6 | Y | N | 146 |
| R9C7 | Y | N | 143 |
| R9C10 | Y | N | 645 |
| R9E5 | Y | N | 179 |
| R9G5 | Y | N | 2717 |
| R10A2 | Y | Y | 4470 |
| R10A9 | Y | N | 12807 |
| R10B10 | Y | Y | 858 |

FACS binding background MFI average was 153

Molecular Characterisation of Rat Antibodies

Six rat antibody hybridomas—R5D1, R7F11, R5E8, R10A2, R10B10 and R7H11—were selected for molecular characterization. RNA extraction from pelleted hybridoma cells of each clone was performed using TRI reagent (Sigma-Aldrich, St. Louis, Mo.) according to manufacturer's directions. The variable regions of each antibody were amplified using Rapid Amplification of cDNA Ends (RACE) reverse transcription polymerase chain reaction (RT-PCR) methodology according to manufacturer's directions (Clontech [Mountain View, Calif.] SMART RACE kit; Ambion Life Technologies [Foster City, Calif.] RLM-RACE kit). Gene-specific reverse PCR primers to amplify the rat heavy chain variable domains by 5'-RACE were designed to anneal to the available rat heavy chain constant region sequences. Similarly, gene specific reverse PCR primers to amplify the rat light chains were designed to anneal to the rat kappa chain constant region sequences, while further primers were designed to anneal to the rat lambda chain constant region sequences.

5'-RACE PCR was performed according to manufacturer's directions (Life Technologies; Clontech) using PfuUltraII polymerase (Agilent). Following 5'-RACE PCR, products were separated by agarose gel electrophoresis and bands of approximately the predicted size based on the location of the reverse primer in the constant region were excised from the gels. DNA was purified from agarose gel slices using a Qiaquick spin gel extraction kit (Qiagen) according to manufacturer's instructions. Insert DNA was cloned and propagated in E. coli using a StrataClone Blunt PCR Cloning Kit (Agilent, Santa Clara, Calif.) according to manufacturer's instructions. Single colonies from transformations were cultured and plasmid DNA prepared using a GenElute™ plasmid miniprep kit (Sigma-Aldrich, St. Louis, Mo.). DNA inserts were sequenced and antibody variable regions identified in the conceptually translated protein sequences.

Vectors were constructed using the rat antibody variable region sequences grafted onto human IgG1 constant sequences for the heavy chain variable region and, human kappa or lambda backbones (keeping the same light chain isotype as in the rat antibodies). The resulting variable region sequences of each clone are listed in Table 23. Subsequent co-expression of the corresponding heavy- and light chains in HEK293-6E cells, in the context of the pTT5 vectors, was followed by protein A purification of the resulting IgGs as described above.

TABLE 23

| Rat antibody | Light chain isotype | Heavy chain (VH) | Light chain (VL) |
| --- | --- | --- | --- |
| R5D1 | Kappa | SEQ ID NO: 399 | SEQ ID NO: 398 |
| R5E8 | Kappa | SEQ ID NO: 401 | SEQ ID NO: 400 |
| R10A2 | Kappa | SEQ ID NO: 403 | SEQ ID NO: 402 |

TABLE 23-continued

| Rat antibody | Light chain isotype | Heavy chain (VH) | Light chain (VL) |
|---|---|---|---|
| R10B10 | Lambda | SEQ ID NO: 425 | SEQ ID NO: 424 |
| R7H11 | Lambda | SEQ ID NO: 427 | SEQ ID NO: 426 |
| R7F11 | kappa | SEQ ID NO: 429 | SEQ ID NO: 428 |

Affinity of Anti-CD38 Antibodies for Human and Cynomolgus Monkey CD38

The binding affinities of a selection of the antibodies produced against human and cynomolgus monkey CD38 were measured. Briefly, using a Biacore T200, Protein A was immobilized onto Flow Cell (FC) 1 (FC1) and FC2 (or alternatively FC3 and FC4) of a CM5 research grade sensor chip using amine coupling, giving approximately 2000 RU. FC1 was used as a blank throughout the experiments. The experiments were run in HBS-P buffer (0.01 M HEPES pH 7.4, 0.15 M NaCl, 0.005% v/v Surfactant P20). At a flow rate of 20 μl/min, 20 μl of 5 μg/mL of antibody was passed over FC2. Human CD38 ED or separately, cynomolgus monkey CD38 ED was passed over the surface of FC1 and FC2 at concentrations ranging from 25 nM to 200 nM. Regeneration of the surface was performed using 10 mM Glycine, pH 1.0. The FC1 sensorgram data was subtracted from FCS and the curves were fitted using a 1:1 Langmuir equation to generate the $k_d$, $k_a$ and $K_D$ values. This data shows that cross-reactivity for human and cynomolgus monkey CD38 is maintained on conversion of the human phage-derived Fabs into human IgGs and rat antibodies into chimeric rat-human IgGs (Table 24).

TABLE 24

| Antibody | CD38 Ligand | ka (1/Ms) × $10^5$ | kd (1/s) | $K_D$ (nM) |
|---|---|---|---|---|
| X355/02 IgG1 | Human | 1.18 | 0.000892 | 7.6 |
| X355/02 IgG1 | Cynomolgus | 0.834 | 0.002282 | 27.4 |
| X355/07 IgG1 | Human | 1.15 | 0.00132 | 11.4 |
| X355/07 IgG1 | Cynomolgus | 11.3 | 0.01375 | 12.2 |
| R10A2 IgG1 | Human | 6.6 | 0.0004.79 | 0.7 |
| R10A2 IgG1 | Cynomolgus | 8.98 | 0.001928 | 2.2 |
| R5D1 IgG1 | Human | 2.43 | 0.000239 | 1.0 |
| R5D1 IgG1 | Cynomolgus | 11.1 | 0.001102 | 1.0 |
| R5E8 IgG1 | Human | 4.05 | 0.00118 | 2.9 |
| R5E8 IgG1 | Cynomolgus | 4.52 | 0.001898 | 4.2 |

Anti-CD38-Attenuated IFN Fusion Protein Constructs

Figure 15:
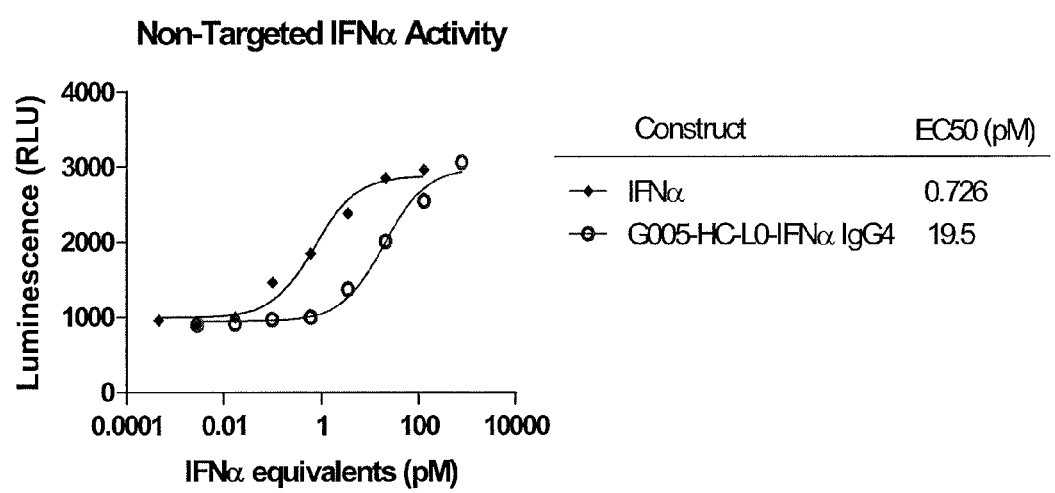
FIG. 15 shows the non-antibody-antigen targeted IFN activity of IFNα2b compared with an anti-CD38-IFNα fusion protein construct (G005-HC-L0-IFNα IgG4), based on the anti-CD38 antibody G005. The assay is described in the examples as the "off-target assay."

To determine whether the surprising result obtained with an anti-CD20 antibody fused to an attenuated IFNα could be replicated with other antibodies, and in particular antibodies targeting an antigen unrelated to CD20, fusion protein constructs comprising the fully human IgG1:kappa anti-CD38 antibody G005 (composed of SEQ ID NOS:135 (heavy chain) and 134 (light chain)) and IFNα (SEQ ID NO:3), with or without various attenuating mutations was made. FIG. 15 shows the results of the "off target assay" (as described above) using the iLite kit. Because faint CD38 signal was observed on the iLite cell line by flow cytometry (not shown), the CD38 antigen was blocked by the addition of excess naked (e.g. without IFN or IFN variants fused to it) anti-CD38 antibody for all iLite experiments using anti-CD38-IFN fusion protein constructs; in each case, the concentration of blocking naked CD38 antibody used was 0.5 mg/ml. Also in each case, the same antibody clone being assayed as an IFN or IFN-variant fusion protein construct was used to block any interaction with CD38.

Figure 16:
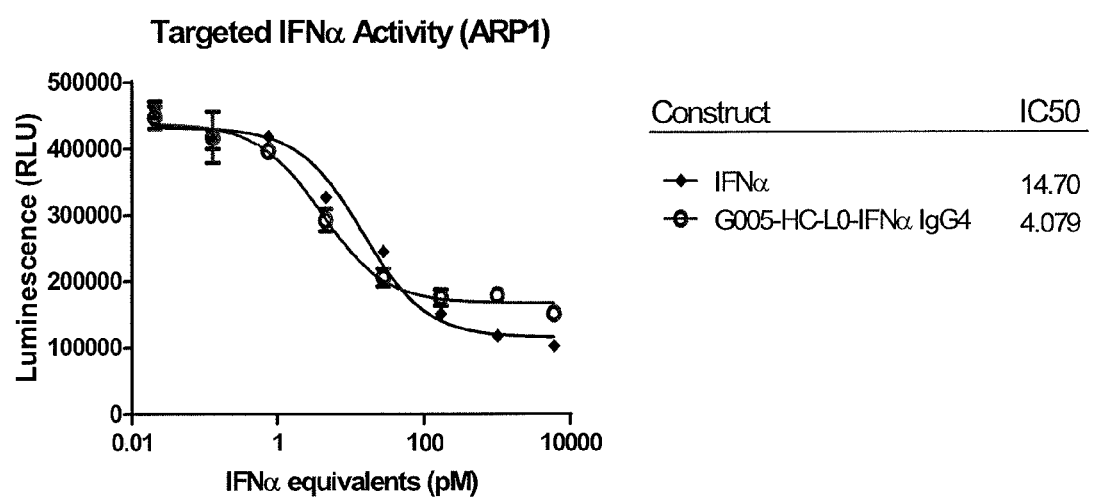
FIG. 16 shows the antiproliferative activity of IFNα2b vs an anti-CD38-IFNα fusion protein construct (G005-HC-L0-IFNα IgG4) on the multiple myeloma cell line ARP-1 (CD38+). The assay is described in the examples as the "on target (ARP) assay."
Figure 17:
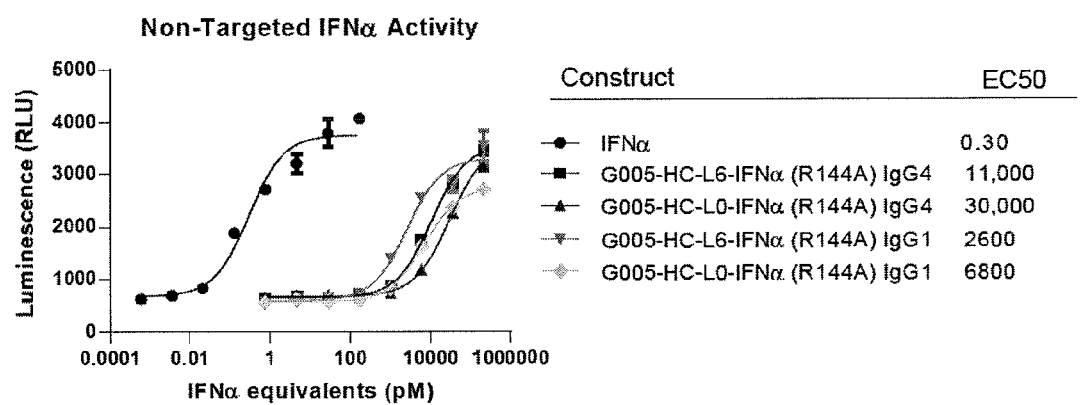
FIG. 17 shows the non-antibody-antigen targeted IFN activity of IFNα2b vs various anti-CD38-IFNα fusion protein constructs bearing point mutations in the IFN portion. The antibody variable regions of these fusion protein constructs were derived from antibody G005. The assay is described in the examples as the "off-target assay."
Figure 18:
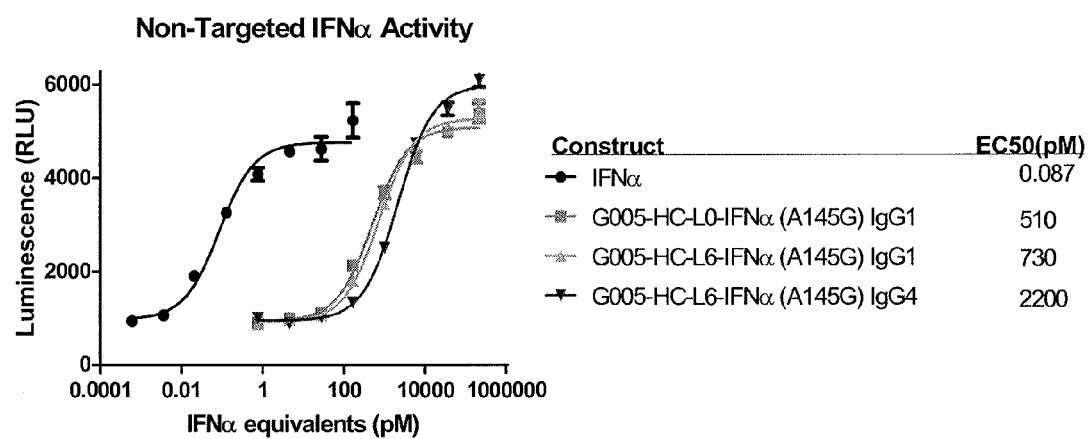
FIG. 18 shows the non-antibody-antigen targeted IFN activity of IFNα2b vs various anti-CD38-IFNα fusion protein constructs bearing point mutations in the IFN portion. The antibody variable regions of these fusion proteins were derived from antibody G005. The assay is described in the examples as the "off-target assay."
Figure 19:
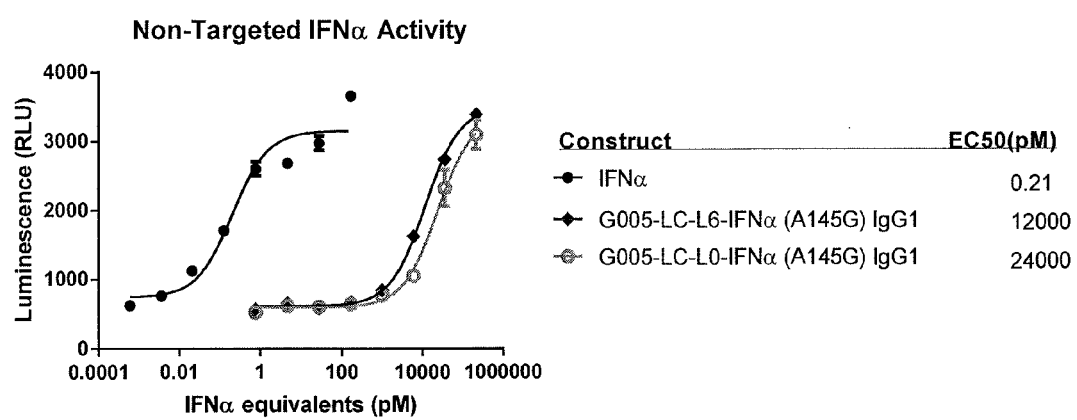
FIG. 19 shows the non-antibody-antigen targeted IFN activity of IFNα2b vs two anti-CD38-IFNα fusion protein constructs bearing point mutations in the IFN portion. The antibody variable regions of these fusion protein constructs are derived from antibody G005. The assay is described in the examples as the "off-target assay."
Figure 20:
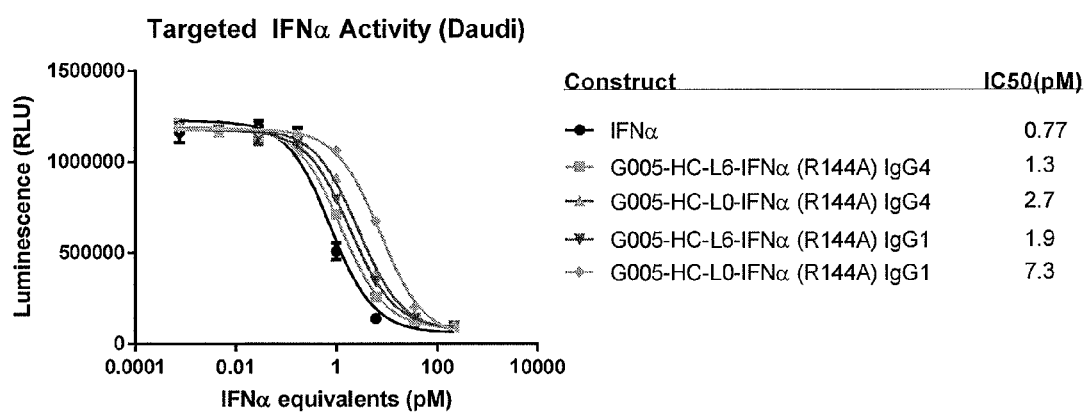
FIG. 20 shows the antiproliferative activity of IFNα2b vs anti-CD38-IFNα fusion protein constructs with mutations in the IFN portion on the lymphoma cell line Daudi. The antibody variable regions of these fusion protein constructs are derived from antibody G005. The assay is described in the examples as the "on target (Daudi) assay."
Figure 21:
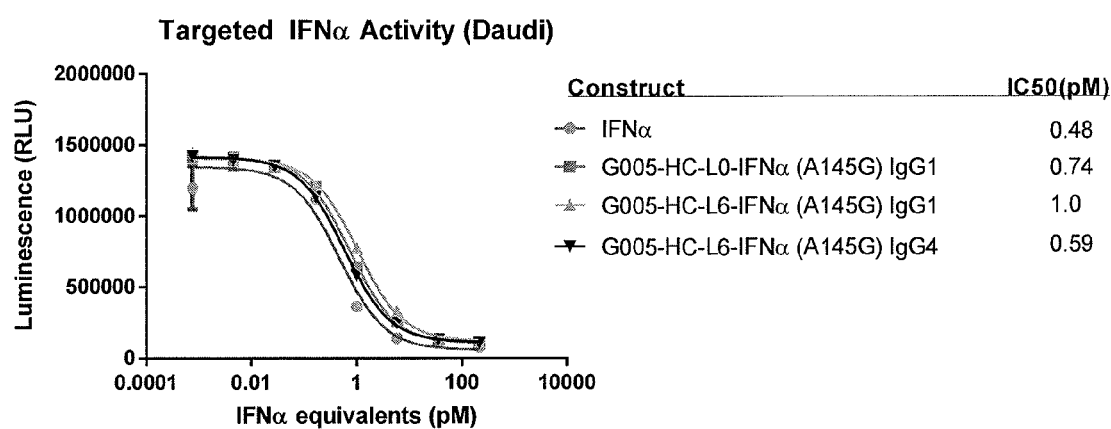
FIG. 21 shows the anti-proliferative activity of IFNα2b and various anti-CD38-IFNα fusion protein with the A145G mutation in the IFN portion. Fusion protein constructs have either the 6 amino acid L6 linker or no linker (L0) and are of the IgG1 or IgG4 isotype. The antibody variable regions of these fusion protein constructs are derived from antibody G005. The assay is described in the examples as the "on target (Daudi) assay".
Figure 22:
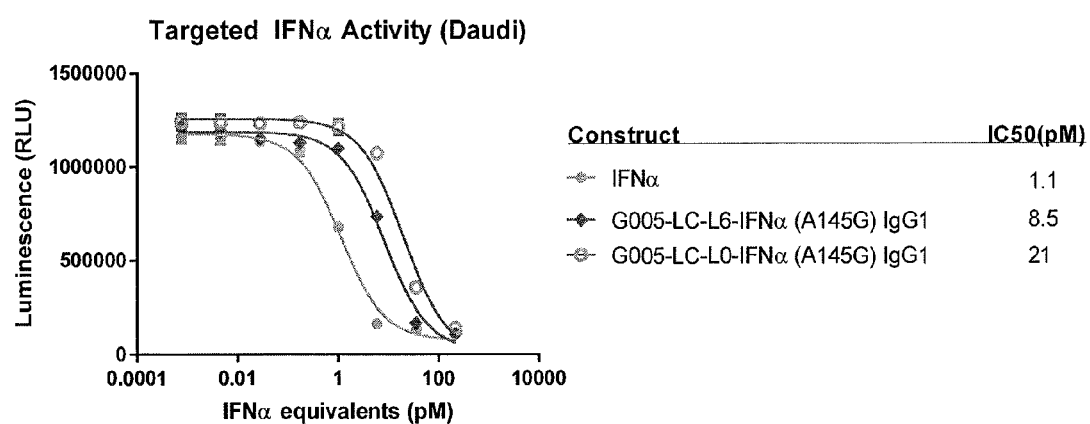
FIG. 22 shows the anti-proliferative activity of IFNα2b and two anti-CD38-IFNα fusion protein with the A145G mutation in the IFN portion. Both fusion protein constructs had the IFN portion linked to the C-terminus of the light chain, with either a six amino acid linker (L6) or no linker (L0). The antibody variable regions of these fusion protein constructs are derived from antibody G005. The assay is described in the examples as the "on target (Daudi) assay."
Figure 23:
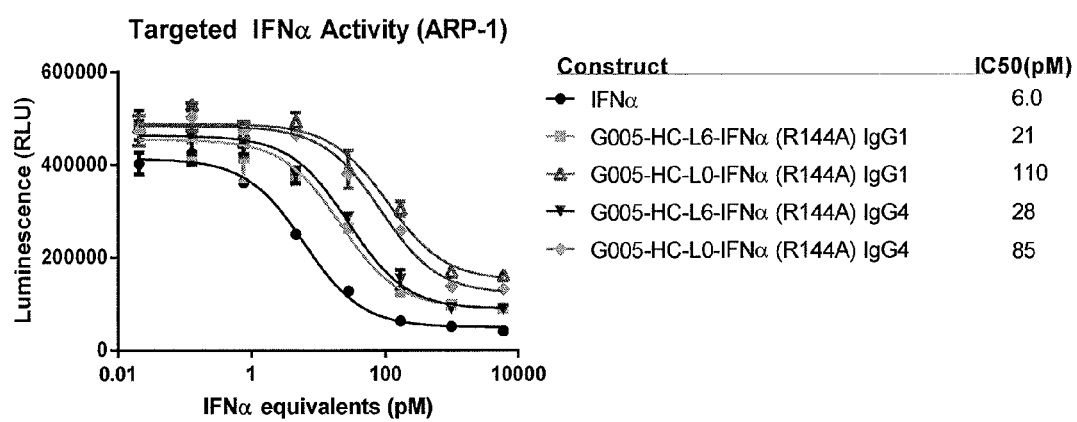
FIG. 23 shows the antiproliferative activity on the multiple myeloma cell line ARP-1 of IFNα2b vs anti-CD38-IFNα fusion protein constructs with the R144A mutation in the IFN portion. The experiment compares the potency of the fusion protein constructs as a function of isotype (IgG1 vs. IgG4) and the presence or absence of the L6 linker between the antibody heavy chain C-terminus and the N-terminus of the mutated IFN. The antibody variable regions of these fusion protein constructs are derived from antibody G005. The assay is described in the examples as the "on target (ARP) assay."
Figure 24:
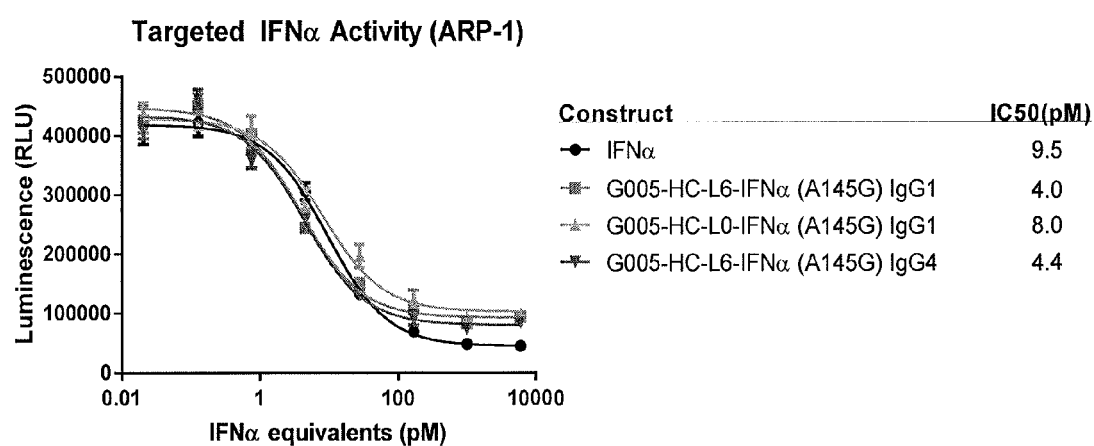
FIG. 24 shows the antiproliferative activity on the multiple myeloma cell line ARP-1 of IFNα2b vs anti-CD38-IFNα fusion protein constructs with the A145G mutation in the IFN portion. The experiment compares the potency of the fusion protein constructs as a function of isotype (IgG1 vs. IgG4) and the presence or absence of the L6 linker between the antibody heavy chain C-terminus and the N-terminus of the mutated IFN. The antibody variable regions of these fusion protein constructs are derived from antibody G005. The assay is described in the examples as the "on target (ARP) assay."
Figure 25:
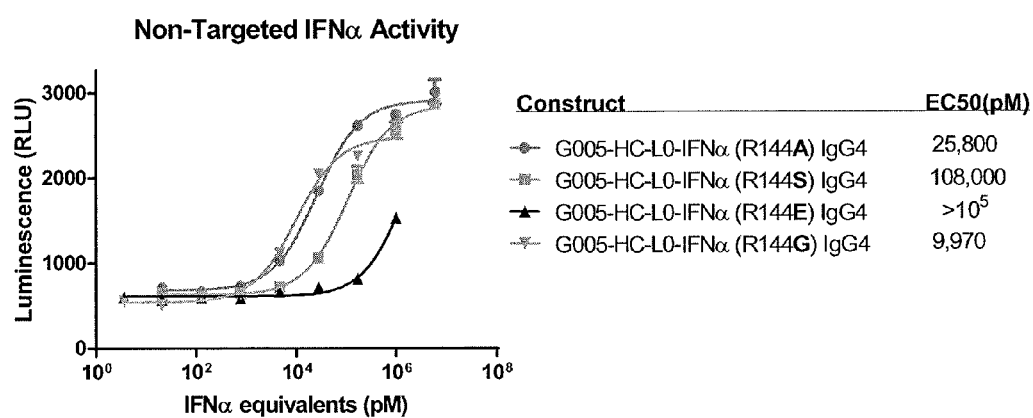
FIG. 25 shows the non-antibody-antigen targeted IFN activity of various anti-CD38-IFNα fusion protein constructs with different point mutations in the IFN portion. The antibody variable regions of these fusion protein constructs are derived from antibody G005. The assay is described in the examples as the "off-target assay."
Figure 26:
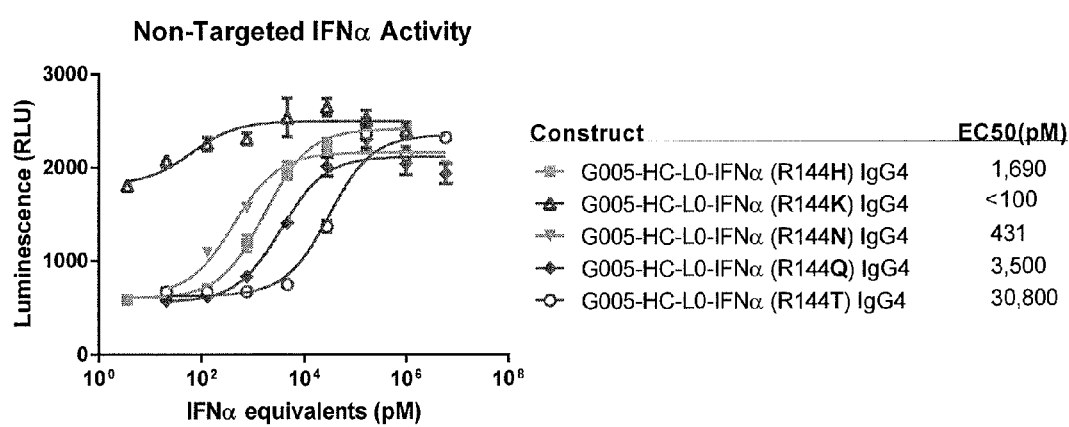
FIG. 26 shows the non-antibody-antigen targeted IFN activity of various anti-CD38-IFNα fusion protein constructs with different point mutations in the IFN portion. The antibody variable regions of these fusion protein constructs are derived from antibody G005. The assay is described in the examples as the "off-target assay."
Figure 27:
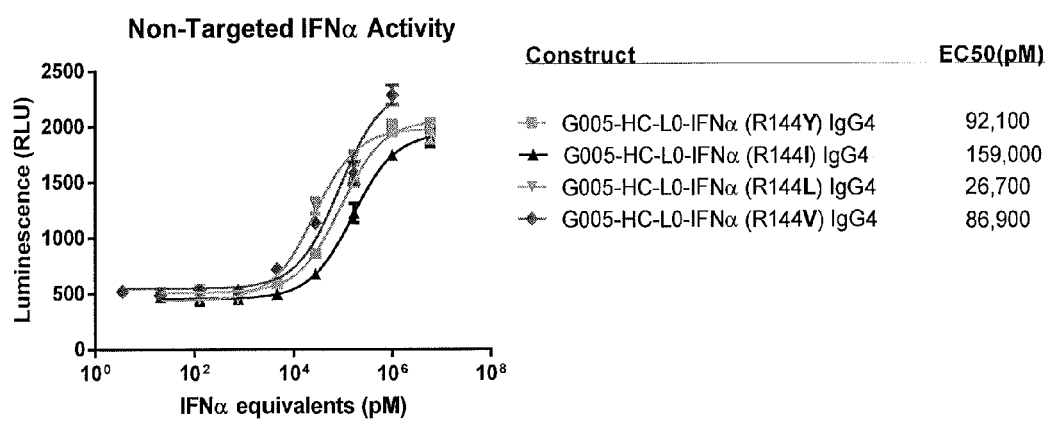
FIG. 27 shows the non-antibody-antigen targeted IFN activity of various anti-CD38-IFNα fusion protein constructs with different point mutations in the IFN portion. The antibody variable regions of these fusion protein constructs are derived from antibody G005. The assay is described in the examples as the "off-target assay."
Figure 28:
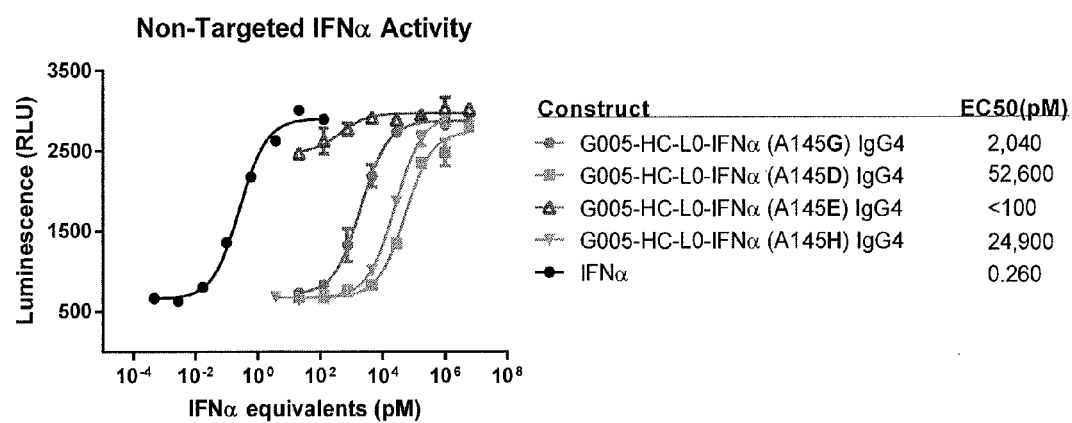
FIG. 28 shows the non-antibody-antigen targeted IFN activity of various anti-CD38-IFNα fusion protein constructs with different point mutations in the IFN portion. The antibody variable regions of these fusion protein constructs are derived from antibody G005. The assay is described in the examples as the "off-target assay."
Figure 29:
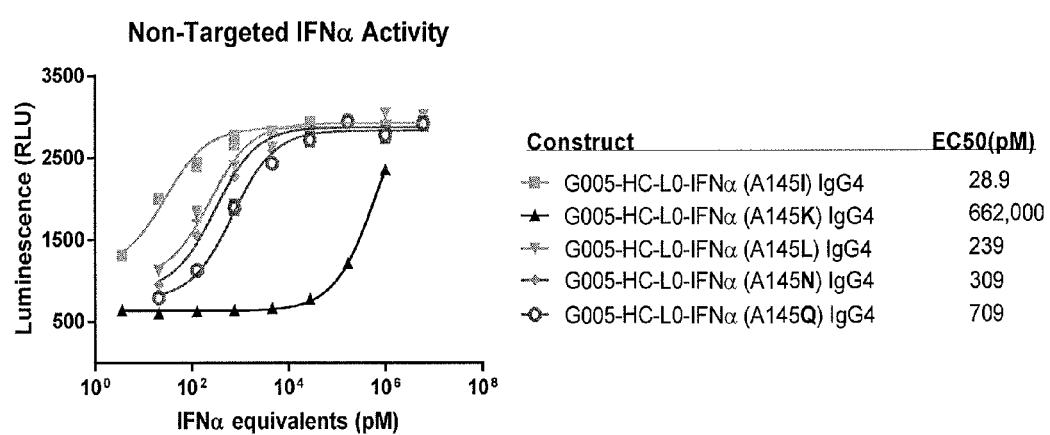
FIG. 29 shows the non-antibody-antigen targeted IFN activity of IFNα2b vs various anti-CD38-IFNα fusion protein constructs with different point mutations in the IFN portion. The antibody variable regions of these fusion protein constructs are derived from antibody G005. The assay is described in the examples as the "off-target assay."
Figure 30:
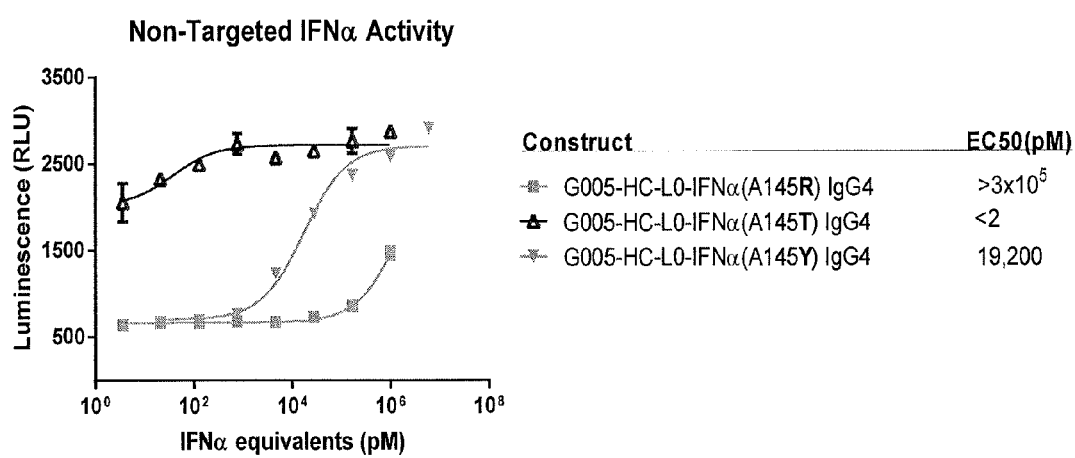
FIG. 30 shows the non-antibody-antigen targeted IFN activity of various anti-CD38-IFNα fusion protein constructs with different point mutations in the IFN portion. The antibody variable regions of these fusion protein constructs are derived from antibody G005. The assay is described in the examples as the "off-target assay."
Figure 31:
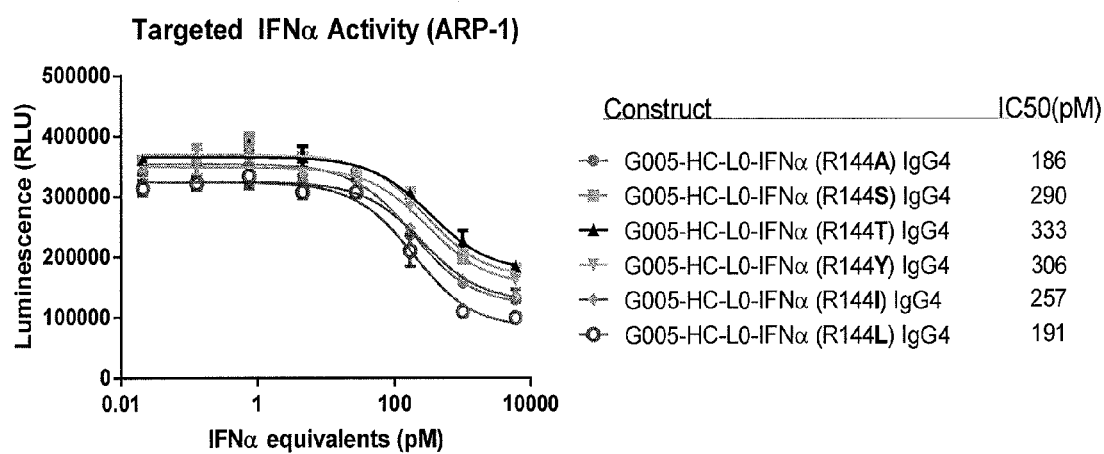
FIG. 31 shows the antiproliferative activity on the multiple myeloma cell line ARP-1 of anti-CD38-IFNα fusion protein constructs with the various mutations in the IFN portion. The antibody variable regions of these fusion protein constructs are derived from antibody G005. The assay is described in the examples as the "on target (ARP) assay."
Figure 32:
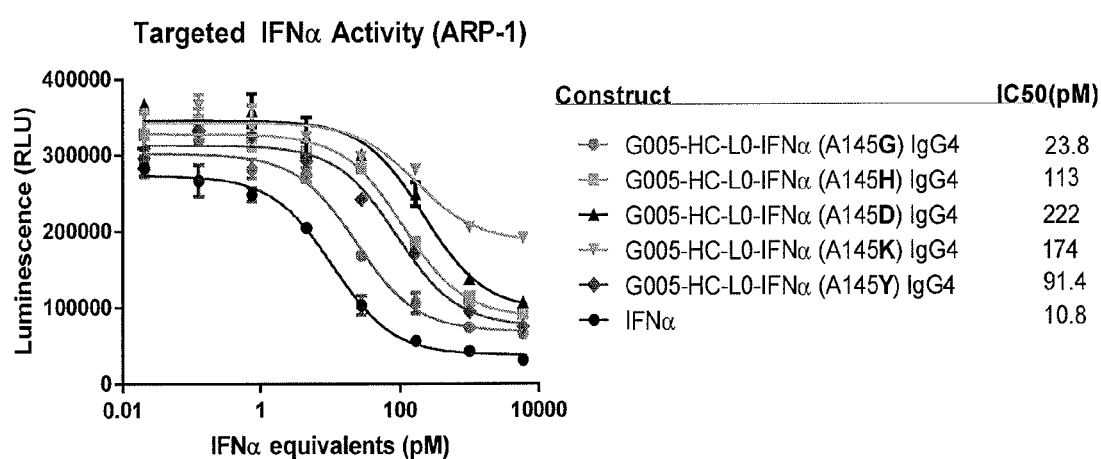
FIG. 32 shows the antiproliferative activity on the multiple myeloma cell line ARP-1 of IFNα2b vs anti-CD38-IFNα fusion protein constructs with the various mutations in the IFN portion. The antibody variable regions of these fusion protein constructs are derived from antibody G005. The assay is described in the examples as the "on target (ARP) assay.".
Figure 33:
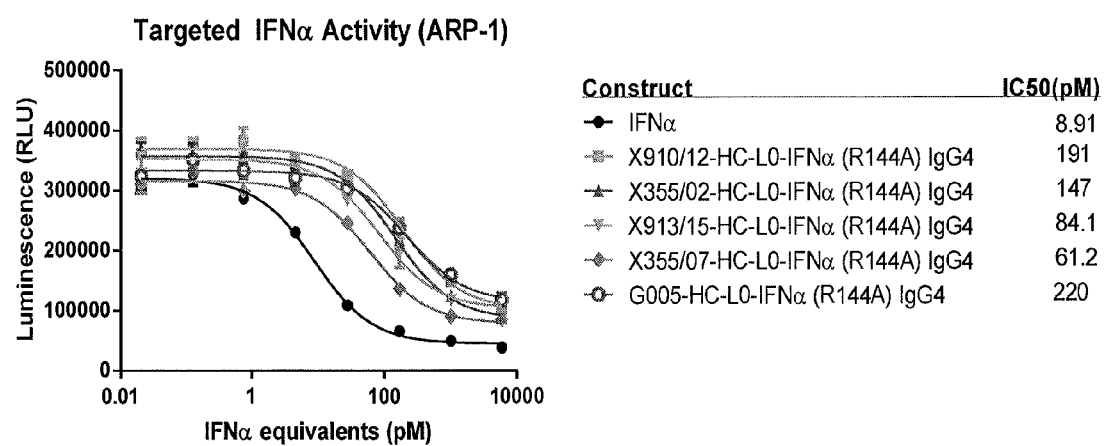
FIG. 33 shows the antiproliferative activity on the multiple myeloma cell line ARP-1 of IFNα2b vs anti-CD38-IFNα fusion protein constructs with the R144A mutation in the IFN portion. The experiment compares different antibody variable regions in the context of the same mutated IFN fusion protein. The assay is described in the examples as the "on target (ARP) assay."
Figure 34:
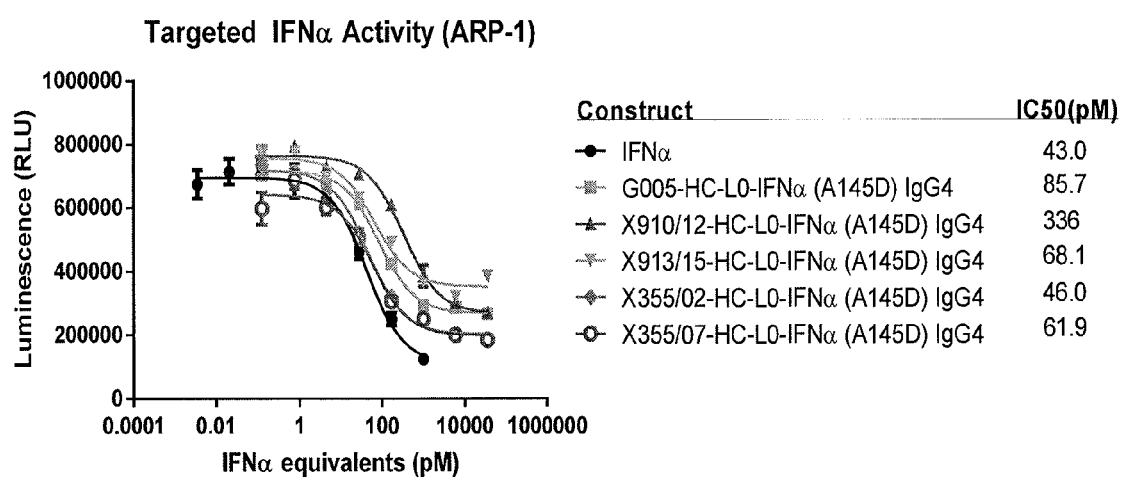
FIG. 34 shows the antiproliferative activity on the multiple myeloma cell line ARP-1 of IFNα2b vs anti-CD38-IFNα fusion protein constructs with the A145D mutation in the IFN portion. The experiment compares different antibody variable regions in the context of the same mutated IFN fusion protein construct. The assay is described in the examples as the "on target (ARP) assay."
Figure 35:
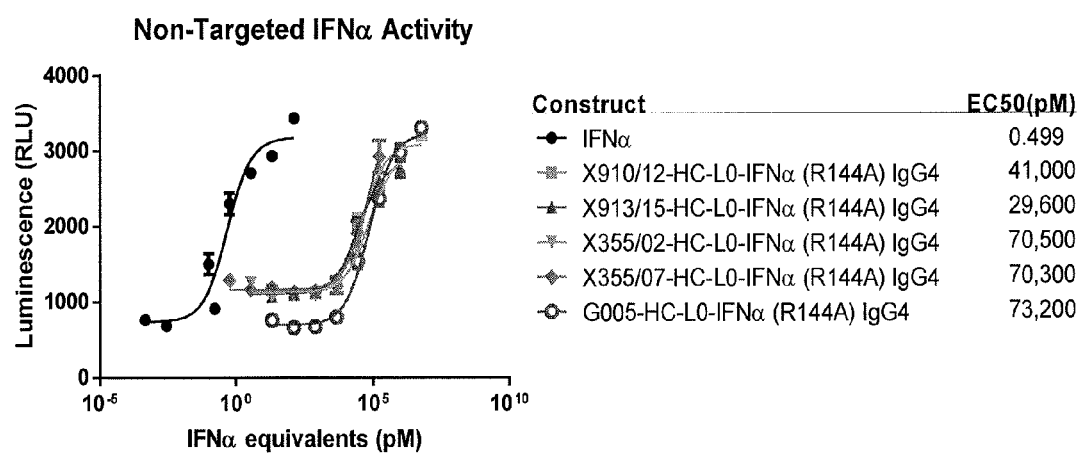
FIG. 35 shows the non-antibody-antigen targeted IFN activity of IFNα2b and various anti-CD38-IFNα fusion protein constructs with the R144A mutation in the IFN portion. The experiment compares different antibody variable regions in the context of the same mutated IFN fusion protein construct. The assay is described in the examples as the "off-target assay."
Figure 36:
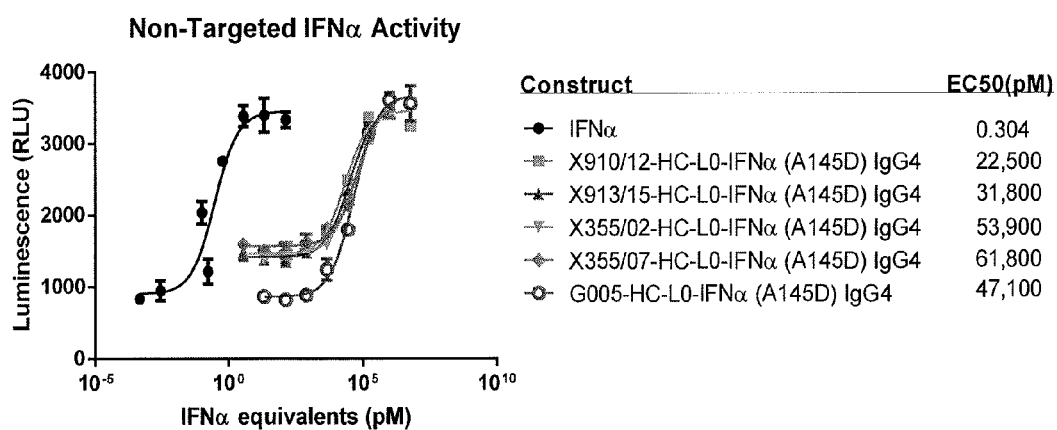
FIG. 36 shows the non-antibody-antigen targeted IFN activity of IFNα2b and various anti-CD38-IFNα fusion protein constructs with the A145D mutation in the IFN portion. The experiment compares different antibody variable regions in the context of the same mutated IFN fusion protein construct. The assay is described in the examples as the "off-target assay."
Figure 37:
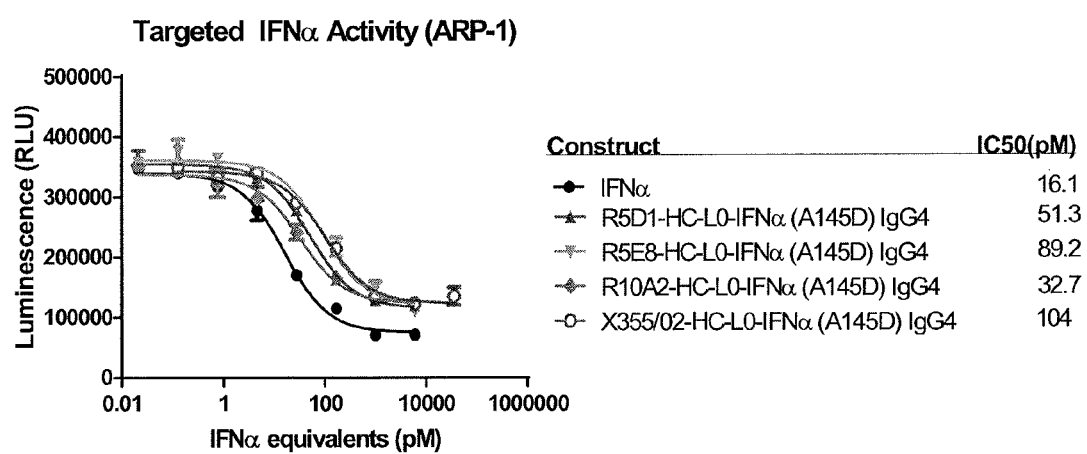
FIG. 37 shows the antiproliferative activity on the multiple myeloma cell line ARP-1 of IFNα2b vs anti-CD38-IFNα fusion protein constructs with the A145D mutation in the IFN portion. The experiment compares different antibody variable regions in the context of the same mutated IFN fusion protein construct. The assay is described in the examples as the "on target (ARP) assay."
Figure 38:
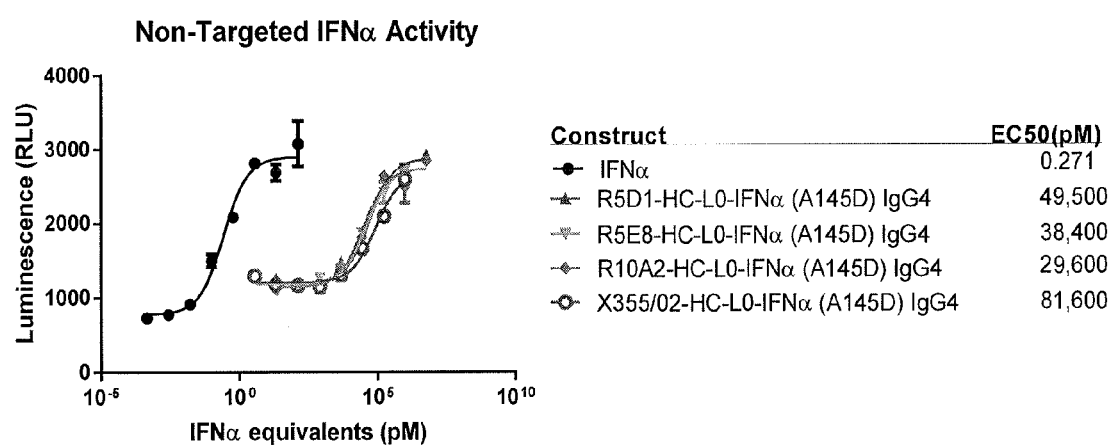
FIG. 38 shows the non-antibody-antigen targeted IFN activity of IFNα2b and various anti-CD38-IFNα fusion protein constructs with the A145D mutation in the IFN portion. The experiment compares different antibody variable regions in the context of the same mutated IFN fusion protein construct. The assay is described in the examples as the "off-target assay."
Figure 39:
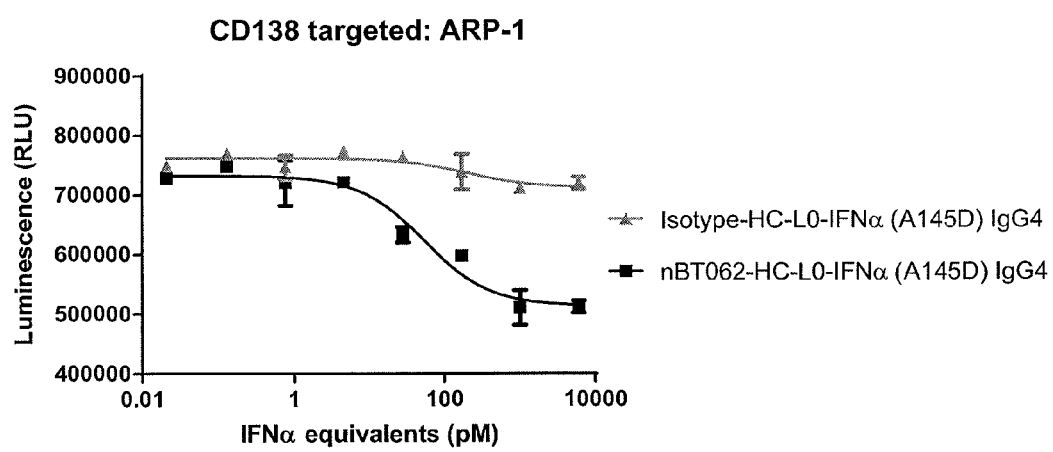
FIG. 39 shows the antiproliferative activity on the multiple myeloma cell line ARP-1 of two antibody-IFNα fusion protein constructs with the A145D mutation in the IFN portion. The nBT062 antibody binds CD138 whereas the "isotype" antibody does not (it is derived from the antibody 2D12). The assay is described in the examples as the "on target (ARP) assay."
Figure 41:
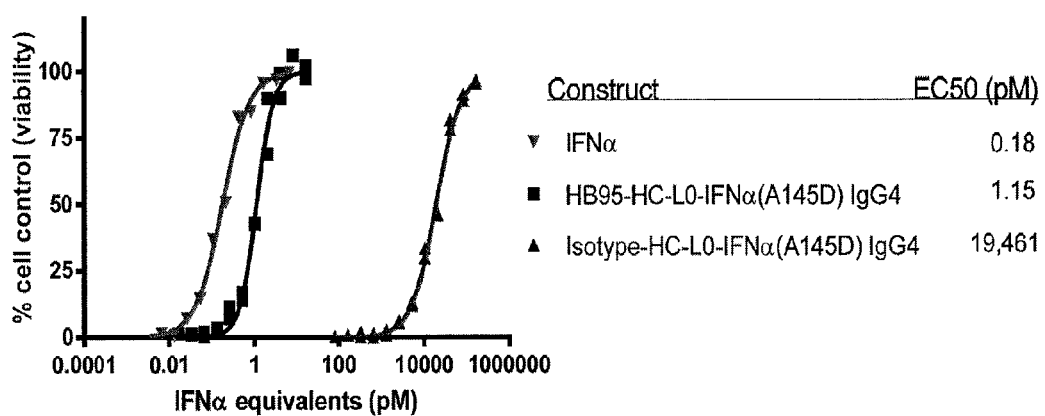
FIG. 41 shows measurements of the antiviral activity of IFNα and two antibody-IFNα fusion protein constructs with the A145D mutation in the IFN portion. This cytopathic effect inhibition assay utilized the cell line A549 and the EMC virus. The HB95 antibody binds human class I MHC (which is expressed on the A549 cells) whereas the "isotype" antibody derived from the antibody 2D12 does not.
Figure 42:
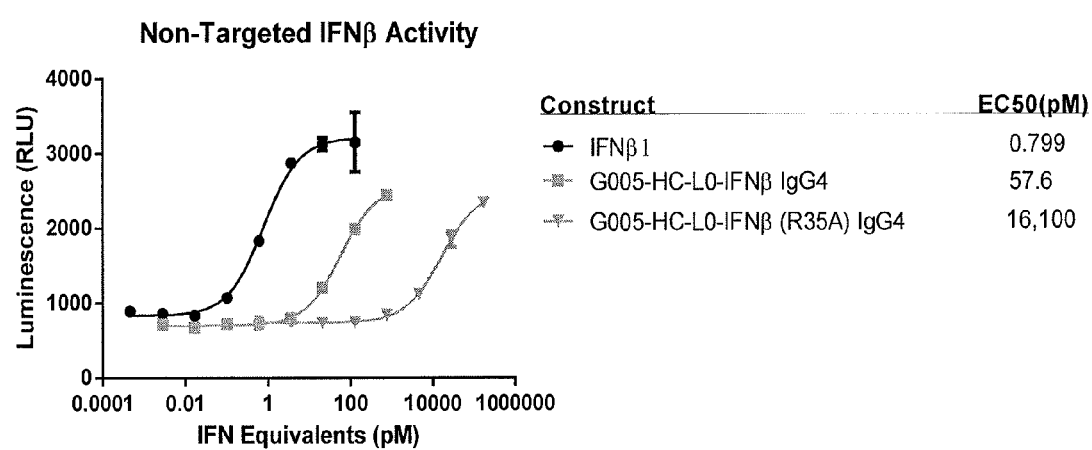
FIG. 42 shows the non-antibody-antigen targeted IFN activity of IFNβ, an anti-CD38-IFNβ fusion protein construct and an identical fusion protein construct but with the attenuating R35A mutation in the IFN portion. The assay is described in the examples as the "off-target assay."
Figure 43:
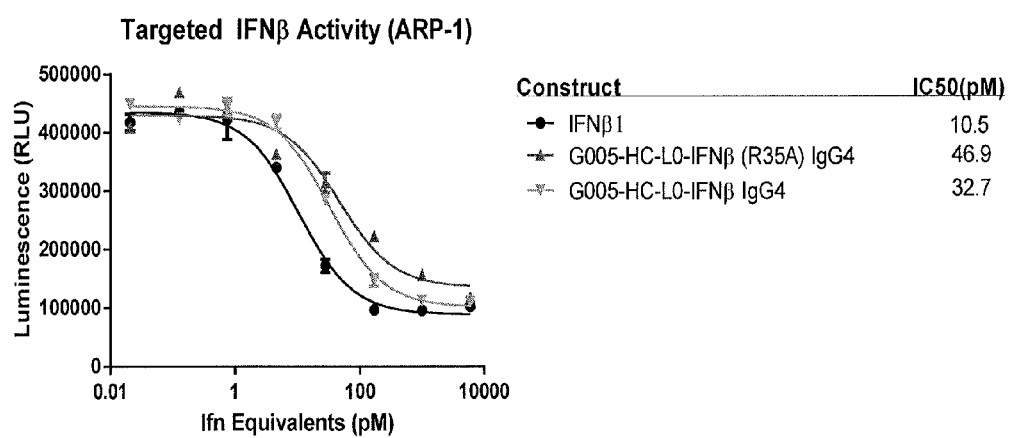
FIG. 43 shows the antiproliferative activity on the multiple myeloma cell line ARP-1 of IFNβ, an anti-CD38-IFNβ fusion protein construct and an identical fusion protein construct but with the attenuating R35A mutation in the IFN portion. The antibody variable regions of these fusion protein constructs are derived from the antibody G005. The assay is described in the examples as the "on target (ARP) assay." "Ifn equivalents" refers to the molar concentration of interferon molecules, either free or attached to an antibody.

FIG. 15 shows the off target activity of free wild type IFNα2b (IFNα(SEQ ID NO:3) vs. wild type IFNα2b fused to the C-terminus of the CD38 antibody G005 (De Weers et al. (U.S. Pat. No. 7,829,673). The latter fusion protein construct (G005-HC-L0-IFNα IgG4) was of IgG4:kappa isotype and had no intervening linker between the C-terminus of the heavy chain and the first residue of the IFNα and is described by SEQ ID NOS:150 (heavy chain) and 134 (light chain). As illustrated in FIG. 15, the anti CD38 antibody-non-attenuated IFNα2b fusion protein construct was 27-fold less potent (19.5/0.726=27) than free IFNα2β in the off-target assay (e.g. in the absence of CD38-targeting). FIG. 16 shows a comparison between the same two constructs in the "on target (ARP1) assay", in which the anti-CD38 antibody was allowed to bind to CD38, which was expressed at high levels on the ARP-1 cell line. The G005-HC-L0-IFNα IgG4 fusion protein construct was 3.6-fold (14.7/4.08=3.6) more potent than free IFNα2b, presumably due to the targeted delivery of the IFN to the $CD38^+$ myeloma cells. Therefore, the G005-HC-L0-IFNα IgG4 fusion protein construct has an antigen specificity index (ASI) of 97 (27×3.6=97; Table 25).

TABLE 25

| Test Article (TA) | EC50 On Target (pM) ARP-1 | EC50 IFNα/EC50 TA (On Target; ARP-1) | EC50 Off Target (pM) iLite | EC50 IFNα/EC50 TA (Off Target; iLite) | Antigen Specificity Index Column 3/Column 5 |
|---|---|---|---|---|---|
| IFNα | 10.8 | 1.00 | 0.260 | 1.00 | 1.00 |
| G005-HC-L0-IFNα IgG4 | | 3.6* | | 0.037** | 97 |
| G005-HC-L0-IFNα (R144A) IgG4 | 186 | 0.0581 | 25,800 | $1.01 \times 10^{-5}$ | 5,750 |
| G005-HC-L0-IFNα (R144S) IgG4 | 290 | 0.0372 | $1.08 \times 10^5$ | $2.41 \times 10^{-6}$ | 15,400 |
| G005-HC-L0-IFNα (R144E) IgG4 | ND | ND | $>10^5$ | ND | ND |
| G005-HC-L0-IFNα (R144G) IgG4 | ND | ND | 9,970 | $2.61 \times 10^{-5}$ | ND |

TABLE 25-continued

| Test Article (TA) | EC50 On Target (pM) ARP-1 | EC50 IFNα/ EC50 TA (On Target; ARP-1) | EC50 Off Target (pM) iLite | EC50 IFNα/ EC50 TA (Off Target; iLite) | Antigen Specificity Index Column 3/ Column 5 |
|---|---|---|---|---|---|
| G005-HC-L0-IFNα (R144H) IgG4 | ND | ND | 1,690 | $1.54 \times 10^{-4}$ | ND |
| G005-HC-L0-IFNα (R144K) IgG4 | ND | ND | <100 | ND | ND |
| G005-HC-L0-IFNα (R144N) IgG4 | ND | ND | 431 | 0.000603 | ND |
| G005-HC-L0-IFNα (R144Q) IgG4 | ND | ND | 3,500 | $7.43 \times 10^{-5}$ | ND |
| G005-HC-L0-IFNα (R144T) IgG4 | 333 | 0.0324 | 30,800 | $8.44 \times 10^{-6}$ | 3,840 |
| G005-HC-L0-IFNα (R144Y) IgG4 | 306 | 0.0353 | 92,100 | $2.82 \times 10^{-6}$ | 12,500 |
| G005-HC-L0-IFNα (R144I) IgG4 | 257 | 0.0420 | $1.59 \times 10^{5}$ | $1.64 \times 10^{-6}$ | 25,600 |
| G005-HC-L0-IFNα (R144L) IgG4 | 191 | 0.0565 | 26,700 | $9.74 \times 10^{-6}$ | 5,800 |
| G005-HC-L0-IFNα (R144V) IgG4 | ND | ND | 86,900 | $2.99 \times 10^{-6}$ | ND |
| G005-HC-L0-IFNα (A145G) IgG4 | 23.8 | 0.454 | 2,040 | 0.000127 | 3,570 |
| G005-HC-L0-IFNα (A145D) IgG4 | 222 | 0.0486 | 52,600 | $4.94 \times 10^{-6}$ | 9,840 |
| G005-HC-L0-IFNα (A145E) IgG4 | ND | ND | <100 | ND | ND |
| G005-HC-L0-IFNα (A145H) IgG4 | 113 | 0.0956 | 24,900 | $1.04 \times 10^{-5}$ | 9,190 |
| G005-HC-L0-IFNα (A145I) IgG4 | ND | ND | 28.9 | 0.00900 | ND |
| G005-HC-L0-IFNα (A145K) IgG4 | 174 | 0.0621 | $6.62 \times 10^{5}$ | $3.93 \times 10^{-7}$ | $1.58 \times 10^{5}$ |
| G005-HC-L0-IFNα (A145L) IgG4 | ND | ND | 239 | 0.00109 | ND |
| G005-HC-L0-IFNα (A145N) IgG4 | ND | ND | 309 | 0.000841 | ND |
| G005-HC-L0-IFNα (A145Q) IgG4 | ND | ND | 709 | 0.000367 | ND |
| G005-HC-L0-IFNα (A145R) IgG4 | ND | ND | $>10^{6}$ | ND | ND |
| G005-HC-L0-IFNα (A145T) IgG4 | ND | ND | <2 | ND | ND |
| G005-HC-L0-IFNα (A145Y) IgG4 | 91.4 | 0.118 | 19,200 | $1.35 \times 10^{-5}$ | 8,740 |

In order to determine whether the ASI could be increased, as was observed for the anti-CD20-IFNα fusion protein constructs, several variants were constructed by attenuating the IFN portion of the anti-CD38-IFNα fusion protein construct by mutation. Numerous different attenuating mutations were made in the context of the G005 or other CD38 monoclonal antibodies. In addition, constructs of different IgG isotypes (IgG1 and IgG4) and linker lengths (L0, no linker; L6, 6 amino acid linker (SGGGGS, SEQ ID NO:132)) were made. The off-target assay and two types of on-target assays (using Daudi and ARP-1), both described in detail above, were run and the results are shown in FIGS. 17-38 and tabulated in Tables 25-33. The discussion below summarizes these results with references to the data in these tables (all of which is derived from FIGS. 17-38).

Table 26 characterizes the CD38 antibody G005, fused in various configurations via the C-terminus of the heavy chain to IFNα with the R144A attenuating mutation. Examples in this table are of IgG1 and IgG4 isotype and either have no linker between the antibody heavy chain and the IFN, L0, or have an intervening 6 amino acid linker, L6 (composed of SEQ ID NOS:138, 140, 152, 146 (heavy chain) each combined with 134 (light chain)). In all cases, the fusion protein constructs had dramatically reduced potency on antigen-negative iLite cells (a reduction of from 8,300 to 100,000 fold compared to free IFNα), but substantially maintained the potency exhibited by free IFNα on CD38 positive cells (Daudi). The G005-HC-L0-IFNα (R144A) IgG4 construct (composed of SEQ ID NOS:152 (heavy chain) and 134 (light chain)), for example, has a $10^5$-fold lower potency than free, wild type IFNα on antigen negative cells but its potency is reduced only 3.5-fold (2.7/0.77=3.5) vs. free, wild type IFNα on antigen positive cells (Table 26). This gives an Antigen Specificity Index (ASI) of 29,000 for this fusion protein construct.

TABLE 26

| Test Article (TA) | EC50 On Target (pM) Daudi | EC50 IFNα/ EC50 TA (On Target; Daudi) | EC50 Off Target (pM) iLite | EC50 IFNα/ EC50 TA (Off Target; iLite) | Antigen Specificity Index Column 3/ Column 5 |
|---|---|---|---|---|---|
| IFNα | 0.77 | 1.0 | 0.30 | 1.0 | 1.0 |
| G005-HC-L6-IFNα (R144A) IgG4 | 1.3 | 0.59 | 11,000 | $2.7 \times 10^{-5}$ | 22,000 |
| G005-HC-L0-IFNα (R144A) IgG4 | 2.7 | 0.29 | 30,000 | $1.0 \times 10^{-5}$ | 29,000 |
| G005-HC-L6-IFNα (R144A) IgG1 | 1.9 | 0.41 | 2,600 | 0.00012 | 3,400 |
| G005-HC-L0-IFNα (R144A) IgG1 | 7.3 | 0.11 | 6,800 | $4.4 \times 10^{-5}$ | 2,500 |

Table 27 shows examples using another IFNα attenuating mutation, A145G, as a construct with the same G005 antibody in either IgG1 or IgG4 isotypes, with either no linker or the L6 linker (composed of SEQ ID NOS:142, 144, 148 (heavy chain) each combined with SEQ ID 134 (light chain)). The G005-HC-L6-IFNα (A145G) IgG4 construct (composed of SEQ ID NOS:148 (heavy chain) and 134 (light chain)), for example, showed an ASI of 20,000.

TABLE 27

| Test Article (TA) | EC50 On Target (pM) Daudi | EC50 IFNα/ EC50 TA (On Target; Daudi) | EC50 Off Target (pM) iLite | EC50 IFNα/ EC50 TA (Off Target; iLite) | Antigen Specificity Index Column 3/ Column 5 |
|---|---|---|---|---|---|
| IFNα | 0.48 | 1.0 | 0.087 | 1.0 | 1.0 |
| G005-HC-L0-IFNα (A145G) IgG1 | 0.74 | 0.65 | 510 | 0.00017 | 3,800 |

TABLE 27-continued

| Test Article (TA) | EC50 On Target (pM) Daudi | EC50 IFNα/ EC50 TA (On Target; Daudi) | EC50 Off Target (pM) iLite | EC50 IFNα/ EC50 TA (Off Target; iLite) | Antigen Specificity Index Column 3/ Column 5 |
|---|---|---|---|---|---|
| G005-HC-L6-IFNα (A145G) IgG1 | 1.0 | 0.48 | 730 | 0.00012 | 4,000 |
| G005-HC-L6-IFNα (A145G) IgG4 | 0.59 | 0.81 | 2200 | $4.0 \times 10^{-5}$ | 20,000 |

Table 28 shows examples in which the mutated IFNα is attached to the light chain rather than the heavy chain, with either no intervening linker or the L6 linker (composed of SEQ ID NOS:210 or 208 (light chain), respectively, each combined with SEQ ID NO:135 (heavy chain)). In both cases, the fusion protein constructs demonstrated a high ASI of 5,900 and 7,200, respectively.

TABLE 28

| Test Article (TA) | EC50 On Target (pM) Daudi | EC50 IFNα/ EC50 TA (On Target; Daudi) | EC50 Off Target (pM) iLite | EC50 IFNα/ EC50 TA (Off Target; iLite) | Antigen Specificity Index Column 3/ Column 5 |
|---|---|---|---|---|---|
| IFNα | 1.1 | 1.0 | 0.21 | 1.0 | 1.0 |
| G005-LC-L6-IFNα (A145G) IgG1 | 8.5 | 0.13 | 12,000 | $1.8 \times 10^{-5}$ | 7,200 |
| G005-LC-L0-IFNα (A145G) IgG1 | 21 | 0.052 | 24,000 | $8.8 \times 10^{-6}$ | 5,900 |

Tables 29 and 30 demonstrate the ASI for the same fusion protein constructs but use an alternative cell line (ARP-1, a myeloma) for determining activity on CD38+ cells. Using this method, the ASIs for these fusion protein constructs ranged from 1,200-55,000.

TABLE 29

| Test Article (TA) | EC50 On Target (pM) ARP-1 | EC50 IFNα/ EC50 TA (On Target; ARP-1) | EC50 Off Target (pM) iLite | EC50 IFNα/ EC50 TA (Off Target; iLite) | Antigen Specificity Index Column 3/ Column 5 |
|---|---|---|---|---|---|
| IFNα | 6.0 | 1.0 | 0.30 | 1.0 | 1.0 |
| G005-HC-L6-IFNα (R144A) IgG4 | 28 | 0.21 | 11,000 | $2.7 \times 10^{-5}$ | 7,800 |
| G005-HC-L0-IFNα (R144A) IgG4 | 85 | 0.071 | 30,000 | $1.0 \times 10^{-5}$ | 7,100 |
| G005-HC-L6-IFNα (R144A) IgG1 | 21 | 0.29 | 2,600 | 0.00012 | 2,400 |

TABLE 29-continued

| Test Article (TA) | EC50 On Target (pM) ARP-1 | EC50 IFNα/ EC50 TA (On Target; ARP-1) | EC50 Off Target (pM) iLite | EC50 IFNα/ EC50 TA (Off Target; iLite) | Antigen Specificity Index Column 3/ Column 5 |
|---|---|---|---|---|---|
| G005-HC-L0-IFNα (R144A) IgG1 | 110 | 0.054 | 6,800 | $4.4 \times 10^{-5}$ | 1,200 |

TABLE 30

| Test Article (TA) | EC50 On Target (pM) ARP-1 | EC50 IFNα/ EC50 TA (On Target; ARP-1) | EC50 Off Target (pM) iLite | EC50 IFNα/ EC50 TA (Off Target; iLite) | Antigen Specificity Index Column 3/ Column 5 |
|---|---|---|---|---|---|
| IFNα | 9.5 | 1.0 | 0.087 | 1.0 | 1.0 |
| G005-HC-L0-IFNα (A145G) IgG1 | 8.0 | 1.2 | 510 | 0.00017 | 7,100 |
| G005-HC-L6-IFNα (A145G) IgG1 | 4.0 | 2.4 | 730 | 0.00012 | 20,000 |
| G005-HC-L6-IFNα (A145G) IgG4 | 4.4 | 2.2 | 2200 | $4.0 \times 10^{-5}$ | 55,000 |

Numerous other examples of mutated versions of IFNα, in the context of the G005-HC-L0-IFNα IgG4 fusion protein construct are set out in Table 25. The majority of these mutants (R144 mutated to A, S, E, G, H, N, Q, T, Y, I, L or V (composed of SEQ ID NOS:152, 172, 156, 158, 160, 168, 170, 174, 178, 162, 166, 176 (heavy chain), respectively, each combined with SEQ ID NO:134 (light chain)) and A145 mutated to G, D, H, I, K, L, N, Q, R or Y (SEQ ID NOS:184, 180, 186, 188, 190, 192, 194, 196, 198, 206 (heavy chain), respectively, each combined with SEQ ID NO:134 (light chain)) showed significant attenuation of IFNα activity compared to free wild type IFNα. In this context, the A145V and A145S mutants did not show appreciable attenuation. Any of these point mutated, attenuated versions of IFNα could be used in the context of the present invention as antibody fusion protein constructs. Certain IFN variants may be preferred due to showing higher ASIs. Other considerations, such as expression level, immunogenicity, biophysical characteristics, etc., may also be considered in evaluating constructs for optimal utility. Of the numerous IFNα variants described in this document, those shown here to yield a high ASI in the context of an antibody-fusion protein construct include R144A, R144S, R144T, R144Y, R144I, R144L, R145G, R145D, R145H, R145Y (Table 25), R33A+YNS (as illustrated in the construct comprising SEQ ID NOS:286 (heavy chain) and 276 (light chain)), R33A (as illustrated in the construct comprising SEQ ID NOS:436 (heavy chain) and 276 (light chain)) and R144A+YNS (such as as illustrated in the construct comprising SEQ ID NOS:288 (heavy chain) and 276 (light chain)).

The mutation of A145D in the construct of SEQ ID NOS:180 (heavy chain) and 134 (light chain) compared to the A145E mutation in the construct of SEQ ID NO:182 (heavy chain) and 134 (light chain) produced unexpected results. Although both constructs have similar amino acid sequences, differing by only a single methylene group, they showed dramatically different effects on the non-targeted activity of the IFNα. The A145E mutation had minimal impact on the IFNα activity, however, the A145D mutation drastically reduced activity (by 20,000-fold) and resulted in a construct with high ASI (9,840).

Other examples of anti-CD38 antibody-attenuated IFNα fusion protein constructs are shown in Tables 31-33. In addition to the G005 antibody constructs, these tables show the on-target activity, the off-target activity, and the ASI for anti-CD38 antibody-attenuated IFNα fusion protein constructs based on certain novel antibodies. Fusion protein constructs of these antibodies with the IFNα A145D or R144A mutations include the following:

X910/12-HC-L0 IFNα (A145D) IgG4 composed of SEQ ID NOS:248 (heavy chain) and SEQ ID NO:242 (light chain)

X910/12-HC-L0 IFNα (R144A) IgG4 composed of SEQ ID NOS:246 (heavy chain) and SEQ ID NO:242 (light chain)

; X913/15-HC-L0 IFNα (A145D) IgG4 composed of SEQ ID NOS:256 (heavy chain) and SEQ ID NO:250 (light chain));

X913/15-HC-L0 IFNα (R144A) IgG4 composed of SEQ ID NOS: 254 (heavy chain) and SEQ ID NO:250 (light chain))

X355/02-HC-L0 IFNα (A145D) IgG4 composed of SEQ ID NOS:232 (heavy chain) and SEQ ID NO:226 (light chain);

X355/02-HC-L0 IFNα (R144A) IgG4 composed of SEQ ID NOS:230 and SEQ ID NO:226 (light chain);

X355/07-HC-L0 IFNα (A145D) IgG4 composed of SEQ ID NOS:240 (heavy chain) and SEQ ID NO:234 (light chain);

X355/07-HC-L0 IFNα (R144A) IgG4 composed of SEQ ID NOS:238 and SEQ ID NO:234 (light chain);

R5D1-HC-L0 IFNα (A145D) IgG4 composed of SEQ ID NOS:262 (heavy chain) and 258 (light chain);

R5E8-HC-L0 IFNα (A145D) IgG4 composed of SEQ ID NOS:268 (heavy chain) and 264 (light chain); and R10A2-HC-L0 IFNα (A145D) IgG4 composed of SEQ ID NOS:274 (heavy chain) and 270 (light chain).

These fusion protein constructs all showed high ASIs, ranging from 3,820 (X910/12-HC-L0-IFNα (R144A) IgG4) to 166,000 (X355/02-HC-L0-IFNα (A145D) IgG4).

TABLE 31

| Test Article (TA) | EC50 On Target (pM) ARP-1 | EC50 IFNα/ EC50 TA (On Target; ARP-1) | EC50 Off Target (pM) iLite | EC50 IFNα/ EC50 TA (Off Target; iLite) | Antigen Specificity Index Column 3/ Column 5 |
|---|---|---|---|---|---|
| IFNα | 8.91 | 1.00 | 0.499 | 1.00 | 1.00 |
| G005-HC-L0-IFNα (R144A) IgG4 | 220 | 0.0405 | 73,200 | $6.82 \times 10^{-6}$ | 5,940 |
| X910/12-HC-L0-IFNα (R144A) IgG4 | 191 | 0.0466 | 41,000 | $1.22 \times 10^{-5}$ | 3,820 |
| X913/15-HC-L0-IFNα (R144A) IgG4 | 84.1 | 0.106 | 29,600 | $1.69 \times 10^{-5}$ | 6,270 |
| X355/02-HC-L0-IFNα (R144A) IgG4 | 147 | 0.0606 | 70,500 | $7.08 \times 10^{-6}$ | 8,560 |

TABLE 31-continued

| Test Article (TA) | EC50 On Target (pM) ARP-1 | EC50 IFNα/ EC50 TA (On Target; ARP-1) | EC50 Off Target (pM) iLite | EC50 IFNα/ EC50 TA (Off Target; iLite) | Antigen Specificity Index Column 3/ Column 5 |
|---|---|---|---|---|---|
| X355/07-HC-L0-IFNα (R144A) IgG4 | 61.2 | 0.146 | 70,300 | $7.10 \times 10^{-6}$ | 20,600 |

TABLE 32

| Test Article (TA) | EC50 On Target (pM) ARP-1 | EC50 IFNα/ EC50 TA (On Target; ARP-1) | EC50 Off Target (pM) iLite | EC50 IFNα/ EC50 TA (Off Target; iLite) | Antigen Specificity Index Column 3/ Column 5 |
|---|---|---|---|---|---|
| IFNα | 43.0 | 1.00 | 0.304 | 1.00 | 1.00 |
| G005-HC-L0-IFNα (A145D) IgG4 | 85.7 | 0.502 | 47,100 | $6.44 \times 10^{-6}$ | 78,000 |
| X910/12-HC-L0-IFNα (A145D) IgG4 | 336 | 0.128 | 22,500 | $1.35 \times 10^{-5}$ | 9480 |
| X913/15-HC-L0-IFNα (A145D) IgG4 | 68.1 | 0.631 | 31,800 | $9.59 \times 10^{-6}$ | 65,800 |
| X355/02-HC-L0-IFNα (A145D) IgG4 | 46.0 | 0.935 | 53,900 | $5.64 \times 10^{-6}$ | $1.66 \times 10^5$ |
| X355/07-HC-L0-IFNα (A145D) IgG4 | 61.9 | 0.695 | 61,800 | $4.92 \times 10^{-6}$ | $1.41 \times 10^5$ |

TABLE 33

| Test Article (TA) | EC50 On Target (pM) ARP-1 | EC50 IFNα/ EC50 TA (On Target; ARP-1) | EC50 Off Target (pM) iLite | EC50 IFNα/ EC50 TA (Off Target; iLite) | Antigen Specificity Index Column 3/ Column 5 |
|---|---|---|---|---|---|
| IFNα | 16.1 | 1.00 | 0.271 | 1.00 | 1.00 |
| R5D1-HC-L0-IFNα (A145D) IgG4 | 51.3 | 0.314 | 49,500 | $5.48 \times 10^{-6}$ | 57,300 |
| R5E8-HC-L0-IFNα (A145D) IgG4 | 89.2 | 0.180 | 38,400 | $7.06 \times 10^{-6}$ | 25,500 |
| R10A2-HC-L0-IFNα (A145D) IgG4 | 32.7 | 0.492 | 29,600 | $9.16 \times 10^{-6}$ | 53,700 |
| X355/02-HC-L0-IFNα (A145D) IgG4 | 104 | 0.155 | 81,600 | $3.32 \times 10^{-6}$ | 46,700 |

The examples above demonstrate that mutated, attenuated forms of IFNα, attached to antibodies targeting CD20 (SEQ ID NO:430) or CD38 (SEQ ID NO:131), show orders of magnitude greater potency in IFN signaling on antigen-positive target cells than on antigen-negative off-target cells. The results below provide further examples using antibodies that target the attenuated IFNα to two other antigens: CD138 and class I MHC.

CD138 (SEQ ID NO:432), also called Syndecan-1, is a heparin sulfate proteoglycan that is thought to function as an adhesion molecule. It is expressed on most multiple myeloma cells (Dhodapkar, Blood; 91: 2679, 1998). Fusion protein constructs consisting of mutated, attenuated IFNα and the CD138-targeting antibody nBT062 (Ikeda, Clin Can Res., 15:4028, 2009; USPTO #20090175863, composed of SEQ ID NOS:330 (heavy chain) and 326 (light chain)) were generated. As shown in FIG. 39, this fusion protein construct, like the anti-CD38-attenuated IFNα fusion protein construct, showed much greater anti-proliferative potency on multiple myeloma cells (ARP-1, on-target assay) than a non-targeted, isotype fusion protein (based on the antibody 2D12). FIG. 39 shows that a 28 pM concentration (4th highest concentration tested) of nBT062-HC-L0-IFNα (A145D) shows greater anti-proliferative activity on the ARP-1 myeloma cell line than does 6 nM (highest concentration tested) of the isotype-HC-L0-IFNα (A145D) protein.

Another antigen that has been described as a potential target for antibody therapy to treat cancer is the Class I MHC (see for example Stein, Leuk. Lymphhoma 52(2):273-84, 2011). In order to determine whether it was possible to apply the present invention in relation to this target, antibody W6/32 (Barnstable et al. (1978), Cell 14:9-20), was obtained by from ATCC (HB95). This antibody reacts with monomorphic determinants on human HLA A, B, C molecules. The antibody variable regions were cloned and sequenced using SMART RACE cDNA Amplification kit (Clontech, Mountain View, Calif.) and Mouse Ig-Primer Sets (Novagen/EMD Chemicals, San Diego, Calif.). The amino acid sequences of the heavy chain and light chain variable regions are shown as SEQ ID NOS:411 and 410, respectively. The chimeric version of HB95, with the murine variable regions and human IgG4 kappa constant regions, fused to IFNα with the A145D mutation (HB95-HC-L0-IFNα (A145D) IgG4, composed of SEQ ID NOS:316 (heavy chain) and 312 (light chain)) was expressed, and its activity was compared to an isotype control antibody fused in the same way to the same IFNα mutant (Isotype-HC-L0-IFNα (A145D) IgG4, where the isotype variable regions were derived from antibody 2D12). The "on-target (ARP-1)" assay was run as described above for the CD38-targeted antibodies (ARP-1 is class I MHC-positive). The results are shown in FIG. 40*a*. The class I MHC-targeted attenuated IFNα is orders of magnitude more potent than the isotype control-attenuated IFNα fusion protein construct on the same cells, coming within about 9-fold (139/16=8.7) of the wild type IFNα. While HB95-HC-L0-IFNα (A145D) IgG4 shows significant activity below 100 pM, the isotype-HC-L0-IFNα (A145D) IgG4 shows no significant activity even at 6 nM.

FIG. 40*b* demonstrates that antibody fragments may substitute for full-length antibodies and provide similar properties, namely high ASIs. This figure shows the effects of various Fab-attenuated IFNα fusion protein constructs on the proliferation of ARP-1 cells. Two non-ARP-1 targeted constructs, "Palivizumab-HC-L6-IFNα (A145D) Fab" (composed of SEQ ID NOS:298 (heavy chain) and 290 (light chain)) and "2D12-HC-L6-IFNα (A145D) Fab" (composed of SEQ ID NOS:356 (heavy chain) and 344 (light chain)), show very low potency on this cell line (EC50's from 2,410-17,000). By contrast, when the Fab portion of the fusion protein construct does target a cell surface antigen, in this case class I MHC, as for the fusion protein construct "HB95-HC-L6-IFNα (A145D) Fab" (composed of SEQ ID NOS:320 (heavy chain) and 312 (light chain)), the potency is even higher than free, wild type IFNα. The antigen-targeted attenuated construct is 2,760-19,450-fold more potent than the non-targeted attenuated constructs.

Antiviral Activity of Targeted, Attenuated IFNα

The anti-viral activity of IFNα is well-known and recombinant IFNα is an FDA-approved treatment for hepatitis C viral infections. The effect of a host cell surface-targeted vs. non-targeted antibody-attenuated IFNα fusion protein construct on the cytopathic activity of the EMC virus on A549 cells, which are class I MHC-positive, was compared.

Methods:

IFN activity was measured using the cytopathic effect inhibition (CPE) assay as described Rubinstein (J. Virol. 37, 755-8, 1981). Briefly, $10^4$ human adenocarcinoma A549 cells (ATCC, Manassas, Kans.) per well were incubated with test sample or IFN (human IFN-α2A) overnight. Cells were then challenged with EMC virus for 48-56 hours, followed by staining with crystal violet. A visual CPE determination was performed, followed by solubilization of the crystal violet and absorbance measurement at 570 nm. Nonlinear regression analysis was performed using a 4-parameter sigmoidal fit with variable slope (GraphPad Prism). One unit of IFNα activity is defined as the amount of interferon required to reduce the cytopathic effect by 50%. The units are determined with respect to the international reference standard for human IFNα2, provided by the National Institutes of Health (see Pestka, S. "Interferon Standards and General Abbreviations," in Methods in Enzymology (S. Pestka, ed.), Academic Press, New York vol 119, pp. 14-23, 1986). The samples tested in this assay were IFNα (Intron A, inverted triangles), Anti-MHC class I targeted attenuated IFNα designated HB95-HC-L0-IFNα (R145D) IgG4 (closed squares), and isotype control (2D12)-attenuated IFNα (Isotype-HC-L0-IFNα (R145D) IgG4; triangles). Data is plotted as viability vs IFNα molar equivalents.

Results:

Results are shown in FIG. 41. In this assay, IFNα protects A549 cells from virally induced cytopathic cell death (CPE) as expected, showing at EC50 of 0.18 pM. Introducing the R145D mutation to the IFNα (and attaching it to an antibody that does not bind to the A549 cells) reduces its anti-viral potency by 108,000-fold (19,461/0.18=108,167). By contrast, by attaching the same mutant IFN to an A549-targeting antibody (HB95), the potency is increase by ~17.000-fold (19,461/1.15=16,923). This corresponds to an ASI of 16,900 (19,461/1.15=16,922).

Targeted, Attenuated IFNβ

IFNβ also has been shown in numerous publications (see above) to have anti-proliferative activity on various types of cancer cells. A fusion protein construct between an anti-CD38 antibody (G005) and IFNβ (SEQ ID NO:91), G005-HC-L0-IFNβ IgG4 (composed of SEQ ID NOS:212 (heavy chain) and 134 (light chain)) as well as an identical construct but carrying a single point mutation (R35A), known to reduce IFNβ potency (Runkel et al. J. Biol. Chem. 273: 8003-8 (1998), composed of SEQ ID NOS:214 (heavy chain) and 134 (light chain)) was therefore made. In both constructs, the unpaired cysteine at position 17 of IFNβ was mutated to a serine in order to improve expression yields and product homogeneity. FIG. 42 shows the activity of these three proteins under conditions where there is no antibody-assisted targeting ("off target assay" using iLite kit). In this assay, the attachment of an IgG onto the N-terminus of IFNβ attenuates its potency by 72-fold (57.6/0.799=72). By making the R35A mutation in this fusion protein construct, its potency is further reduced by 280-fold (16,100/57.6=280) so that it is 20,150-fold (16,100/0.799=20,150) less potent than free, wild type IFNβ. In stark contrast, FIG. 43 shows the potency of these three proteins under conditions in which the CD38 antibody can target the IFNβ to cells is fairly similar. In this assay, the antibody-attenuated IFNβ fusion protein construct (G005-HC-L0-IFNβ (R35A) IgG4) is only 1.4-fold (46.9/32.7=1.4) less potent than the antibody-non-attenuated IFNβ fusion protein construct and only 4.5-fold (46.9/10.5=4.5) less potent than free, wild type IFNβ. This data is summarized in Table 34. This demonstrates that the surprising finding that attenuating mutations in an interferon that is part of an antibody-IFN fusion protein construct can disproportionally affect non-targeted vs. targeted cells, as observed for IFNα (Table 20), also holds true for IFNβ. In the present example of the anti-CD38-IFNβ fusion protein constructs, the attenuating mutation reduced the potency by only 1.4-fold under conditions when the antibody could direct the IFN to the target cells, vs. 280-fold for cells in which the fusion protein construct could not target the cell surface antigen. As a result, the antibody-attenuated IFNβ fusion protein construct in the present example shows an ASI of 4,630 (Table 34). The R147A mutation in IFNβ, as an alternative to the R35A mutation, was also found to produce antibody-IFNβ fusion protein constructs with a significantly greater ASI than free IFNβ (data not shown). The examples below will show that this "selective attenuation" can also be observed with ligands that are structurally unrelated to IFNα and β, namely to IL-4 and IL-6.

TABLE 34

| Test Article (TA) | EC50 On Target (pM) ARP-1 | EC50 IFNβ/ EC50 TA (On Target; ARP-1) | EC50 Off Target (pM) iLite | EC50 IFNβ/ EC50 TA (Off Target; iLite) | Antigen Specificity Index Column 3/ Column 5 |
|---|---|---|---|---|---|
| IFNβ | 10.5 | 1.00 | 0.799 | 1.00 | 1.00 |
| G005-HC-L0-IFNβ (R35A) IgG4 | 46.9 | 0.224 | 16,100 | $4.84 \times 10^{-5}$ | 4,630 |
| G005-HC-L0-IFNβ IgG4 | 32.7 | 0.321 | 57.6 | 0.0135 | 23.8 |

Interleukin-4 (IL-4)

IL-4 is a helical bundle cytokine with multiple physiological activities, including the ability to bias T helper cell development towards Th2 and away from Th1. Since Th1 cells play a pathological role in certain autoimmune settings, it could be therapeutically advantageous to use IL-4 to influence T helper cell development away from Th1, i.e. to create a "Th1 diversion." To avoid side effects related to IL-4's activity on other cell types, it would be advantageous to attenuate IL-4's activity by mutating it, and then attach it to an antibody that would direct it to activated (preferentially recently activated) helper T cells. The antibody chosen for this purpose was J110, a mouse anti-human PD-1 clone described by Iwai et. al. (Immunol Lett. 83:215-20, 2002). PD-1 (SEQ ID NO:431) is expressed on recently activated Th0 cells.

The J110 antibody (murine variable regions and human IgG1:kappa constant regions; the amino acid sequences of J110 heavy and light chain variable regions are shown as SEQ ID NOS:409 and 408, respectively) was fused to human IL-4 (SEQ ID NO:119), the latter being attached to the C-terminus of the heavy chains with an intervening six amino acid linker, L6 (SGGGGS, SEQ ID NO:132). In addition to this J110-HC-L6-IL4 IgG1 protein (composed of SEQ ID NOS:304 (heavy chain) and 300 (light chain)), a variant of this with a single substitution in the IL-4 component, J110-HC-L6-IL-4 (R88Q) IgG1 (composed of SEQ ID NOS:306 (heavy chain) and 300 (light chain)) was made.

The R88Q mutation in IL-4 has been reported to reduce its potency in vitro (Kruse, EMBO Journal vol. 12 no. 13 pp. 5121-5129, 1993).

Methods:

The "off-target (HB-IL4) assay" was performed largely as described by the manufacturer of the HEK-Blue IL4/IL13 cell line. HEK-Blue™ IL-4/IL-13 Cells are specifically designed to monitor the activation of the STAT6 pathway, which is induced by IL-4. The cells were generated by introducing the human STAT6 gene into HEK293 cells to obtain a fully active STAT6 signaling pathway. The HEK-Blue™ IL-4/IL-13 Cells stably express a reporter gene, secreted embryonic alkaline phosphatase (SEAP), under the control of the IFNβ minimal promoter fused to four STAT6 binding sites. Activation of the STAT6 pathway in HEK-Blue™ IL-4/IL-13 cells induces the expression of the SEAP reporter gene. SEAP is then secreted into the media and can be quantitated using the colorimetric reagent QUANTI-Blue™. Briefly, HEK-Blue IL4/IL13 cells (Invivogen, San Diego Calif. cat# hkb-stat6) were thawed and cultured in DMEM media (Mediatech, Manassas Va., cat#10-013-CV)+ 10% FBS (Hyclone, Logan Utah, cat# SH30070.03) that had been heat inactivated (HI FBS). After one passage, 10 µg/ml blasticidin (Invivogen cat# ant-bl-1) and 100 micrograms/ml Zeocin (Invivogen cat# ant-zn-1) were added to the culture medium. After one more passage, cells were allowed to reach 60-80% confluence and then lifted with Cell Stripper (Mediatech, cat#25-056-Cl). Cells were washed twice in DMEM+HI FBS and counted. Cells were adjusted to 2.8× $10^5$ viable cells/ml in DMEM+HI FBS and 180 µl was aliquoted per well into a flat bottom 96 well tissue culture plate (hereafter, the "experimental plate"). Then, 20 µl of IL-4 or fusion protein construct, diluted into DMEM+HI FBS, was added per well. The plate was incubated at 37° C. 5% $CO_2$ for 16-24 hours. QUANTI-Blue (Invivogen, cat# rep-qb1) was prepared according to the manufacturer's directions. QUANTI-Blue (160 µl) was aliquoted into each well of a flat bottom plate (hereafter, the "assay plate"). Then, 40 µl supernatant per well from the experimental plate was transferred to assay plate. Assay plate was then incubated at 37° C. for 1-3 hours. Assay plate absorbance at 630 nm was read on a model 1420-41 Victor 3V Multilabel Counter from Perkin-Elmer. Data was analyzed using Graph Pad Prism.

The "on target (Th1 diversion) assay" was designed to monitor the percentage of CD4$^+$ T cells that were of Th1 phenotype, as defined by their expression of IFN-γ. Th1 diversion is thereby quantified by a decrease in IFN-γ-positive CD4 T cells. The assay was performed as follows: "Loaded" Dynabeads (M450 Epoxy beads, Invitrogen Dynal, Oslo, Norway cat#140.11) were made as described by the manufacturer with 1.0 µg/$10^7$ beads anti-human CD3 epsilon antibody (R&D Systems, Minneapolis Minn., cat# MAB100), 1.0 µg/$10^7$ beads anti-human CD28 antibody (R&D Systems, cat# MAB342) and 3 µg/$10^7$ beads human IgG (R&D Systems, cat#1-001-A). PBMCs were obtained from the Stanford Blood Center; Palo Alto Calif. Naïve CD4$^+$ T cells were purified from Leukocyte Reduction System (LRS) cones using the naïve CD4$^+$ kit (Miltenyi Biotech cat#130-094-131) according to the manufacturer's directions. A total of 4.0×$10^5$ purified naïve CD4$^+$ T-cells were aliquoted to each well of a 24 well tissue culture plate (hereafter, the "experimental plate") in 1.3 ml in RPMI 1640 (Mediatech, cat#10-040-CV)+10% HI FBS+100 units/ml IL-2 (Peprotech, cat#200-02), hereafter referred to as Media-Q. Then, 4.0×$10^5$ "loaded" Dynabeads were added per well. IL-12 (Peprotech, cat#200-12) was diluted into Media-Q and 100 µl was added to appropriate wells, giving a final concentration of 10 ng/ml. Fusion protein constructs or IL-4 were diluted into Media-Q and 100 µl was added to the appropriate wells. Media-Q was added to appropriate wells to bring the total volume of each well to 1.5 ml. The experimental plate was incubated at 37° C. with 5% $CO_2$ for five days. On the morning of the fifth day, Phorbol myristate acetate (PMA) was added to all wells at a final concentration of 50 ng/ml and ionomycin was also added to all wells at a final concentration of 1.0 µg/ml. Brefeldin A was added to a final concentration of 1.0 µg/ml of culture. The experimental plate was incubated at 37° C. with 5% $CO_2$ for a minimum of four hours. Approximately ⅓ of the volume of each well of the experimental plate was then recovered and subjected to preparation for Intra-cellular Flow Cytometry according to the instructions supplied with the abovementioned Kit and utilizing the reagents supplied with the kit. The cells were stained for intra-cellular interferon-gamma with an anti human interferon-gamma antibody conjugated to AF647 (eBiosciences.com, cat#51-7319-42). The samples were analyzed by flow cytometry on a Becton Dickinson FACSort using Cell Quest software. Acquired samples were analyzed using FloJo Software and data were graphed using Graph Pad Prism software.

Figure 44:
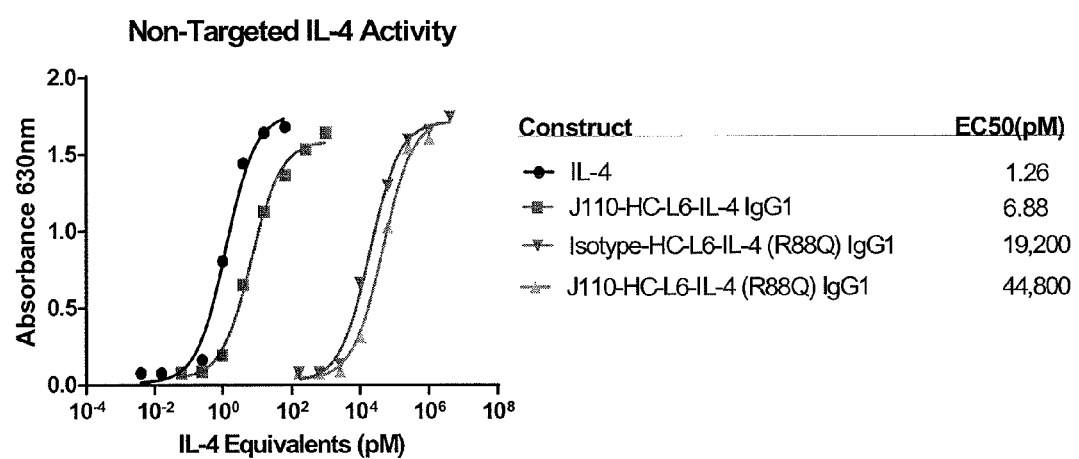
FIG. 44 shows the non-antibody-antigen-targeted IL-4 activity ["off-target (HB-IL4) assay"] of IL-4 and three antibody-IL-4 fusion protein constructs: J110-HC-L6-IL-4 IgG1, an anti-PD1 antibody fused to wild type IL-4; J110-HC-L6-IL-4 (R88Q), which is identical to the previously mentioned fusion protein construct except for the attenuating R88Q mutation in the IL-4 portion; and Isotype-HC-L6-IL-4 (R88Q), based on the 2D12 antibody, which does not bind to any of the cells used in the assays of the present invention, and is fused to the attenuated IL-4. "IL-4 equivalents" refers to the molar concentration of IL-4 molecules, either free or attached to an antibody.
Figure 45:
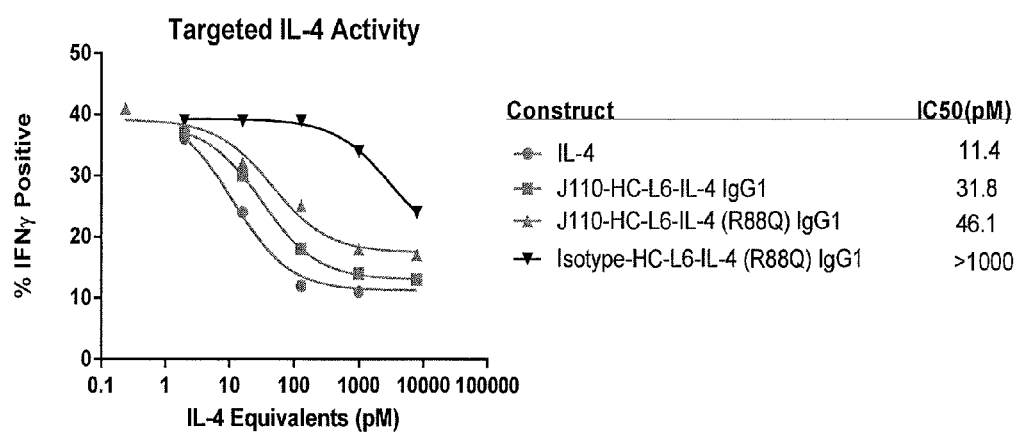
FIG. 45 shows the "on target (Th1 diversion) assay" comparing the activity of IL-4 and three antibody-IL-4 fusion protein constructs: J110-HC-L6-IL-4 IgG1, an anti-PD1 antibody fused to wild type IL-4; J110-HC-L6-IL-4 (R88Q), which is identical to the previously mentioned fusion protein construct except for the attenuating R88Q mutation in the IL-4 portion; and Isotype-HC-L6-IL-4 (R88Q), based on the 2D12 antibody, which does not bind to any of the cells used in the assays of the present invention, and is fused to the attenuated IL-4. "IL-4 equivalents" refers to the molar concentration of IL-4 molecules, either free or attached to an antibody.

Results:

In the absence of antibody-based targeting, as measured by the "off-target (HB-IL4) assay," IL4 showed an EC50 of 1.26 pM (FIG. 44; Table 35). The attachment of an IgG1 to IL4 (e.g. the construct J110-HC-L6-IL4 IgG1, in which the wild type human IL-4 sequence was attached to the C-terminus of the chimeric J110 antibody that recognizes PD-1, with an intervening linker L6) reduced the potency by 5.46-fold (6.88/1.26=5.46). By introducing the R88Q point mutation into the IL-4 portion of this construct, the potency was further reduced to 35,600-fold (44,800/1.26=35,555) below free IL-4. A second antibody-IL-4 (R88Q) fusion protein construct (Isotype-HC-L6-IL4 (R88Q) IgG1, composed of SEQ ID NOS:358 (heavy chain) and 344 (light chain)) showed similar potency. The isotype antibody used in this experiment was 2D12.

TABLE 35

| Test Article (TA) | EC50 On Target (pM) Th1 Diversion | EC50 IL4/ EC50 TA (Th1 Diversion) | EC50 Off Target (pM) HB-IL4 | EC50 IL4/ EC50 TA (Off Target; HB-IL4) | Antigen Specificity Index Column 3/ Column 5 |
|---|---|---|---|---|---|
| IL4 | 11.4 | 1.00 | 1.26 | 1.00 | 1.00 |
| J110-HC-L6-IL4 IgG1 | 31.8 | 0.358 | 6.88 | 0.183 | 1.96 |
| J110-HC-L6-IL4 (R88Q) IgG1 | 46.1 | 0.247 | 44,800 | $2.81\times10^{-5}$ | 8,790 |
| Isotype-HC-L6-IL4 (R88Q) IgG1 | >1000 | ND | 19,200 | $6.56\times10^{-5}$ | ND |

The "on target (Th1 diversion) assay" results are shown in FIG. 45. Activation of the naïve (Th0) CD4 cells induces PD-1 expression, so that the anti-PD1-IL-4 fusion protein constructs may target the IL-4 to them. In this assay, free, wild type IL4 shows an EC50 of 11.4 pM. Remarkably, the anti-PD1-attenuated IL-4 fusion protein construct (J110-HC-L6-IL4 (R88Q) IgG1), which was 35,600-fold less potent than free, wild type IL-4 in the "off-target (HB-IL4)

assay," was almost as potent as IL-4 in this on-target assay (¼th as potent; 11.4/46.1=0.25). The non-attenuated, PD-1 targeted fusion protein construct (J110-HC-L6-IL4 IgG1) was only slightly more potent than the attenuated form (1.45× more potent; 46.1/31.8=1.45). The non-targeted, attenuated IL-4 fusion protein construct (Isotype-HC-L6-IL4 R88Q) IgG1, was significantly less potent than the targeted attenuated fusion protein construct, but its potency was too low to accurately determine an EC50 in this experiment.

Interleukin-6 (IL-6)

IL-6 (SEQ ID NO:123) has numerous activities on different cell types and it may be advantageous to exploit some of these activities at the expense of others. For example, by targeting newly activated CD4+ T cells (via attachment to an anti-PD1 antibody, as in the example above with IL-4 targeting, for example), one may shift the T helper cell population away from the Treg pathway and in favor of the Th17 pathway. This could be advantageous to a cancer patient.

Methods:

The "IL-6 bioassay" was performed using the HEK-Blue™ IL-6 cells (Invivogen, cat# hkb-il6), an engineered reporter cell line that monitors the activation of the JAK-STAT pathway by IL-6. These cells were generated by introducing the human IL-6R gene into HEK293 cells. In addition, cells were further transfected with a reporter gene expressing SEAP under the control of the IFNβ minimal promoter fused to four STAT3 binding sites. In these cells, IL-6 stimulates the activation of STAT3 and leads to the secretion of SEAP. SEAP is then monitored when using the SEAP detection medium QUANTI-Blue™. The assay was run essentially according to the manufacturer's (Invivogen) instructions. Briefly, HEK-Blue IL6 cells were thawed and cultured in DMEM (Mediatech, Manassas Va., cat#10-013-CV)+10% FBS (Hyclone, Logan Utah, cat# SH30070.03) that had been heat inactivated (HI FBS). After one passage, 200 µg/ml HygroGold, (Invivogen cat# ant-hg-1) and 100 µg/ml Zeocin, (Invivogen cat# ant-zn-1) was added to the culture medium. After one more passage, cells were allowed to reach 60-80% confluence and then lifted with Cell Stripper (Mediatech, cat#25-056-Cl). Cells were then washed twice in DMEM+HI FBS and counted. Cells were adjusted to 2.8×10$^5$ viable cells/ml in DMEM+HI FBS and 180 ul was aliquoted per well into a flat bottom 96 well tissue culture plate (hereafter, the "experimental plate"). Then, 20 µl of IL-6 or fusion protein construct, diluted into DMEM+HI FBS, was added per well. The plate was incubated at 37° C. with 5% CO$_2$ for 16-24 hours. QUANTI-Blue (Invivogen, cat# rep-qb1), prepared according to the manufacturer's instructions, was then aliquoted (160 µl per well) into each well of a flat bottom plate (hereafter, the "assay plate"). Then, 40 µl supernatant per well from the experimental plate was transferred to the wells of the assay plate. The assay plate was incubated at 37° C. for 1-3 hours. Assay plate absorbance at 630 nm was read on a model 1420-41 Victor 3V Multilabel Counter from Perkin-Elmer. Data was analyzed using Graph Pad Prism.

Figure 46:
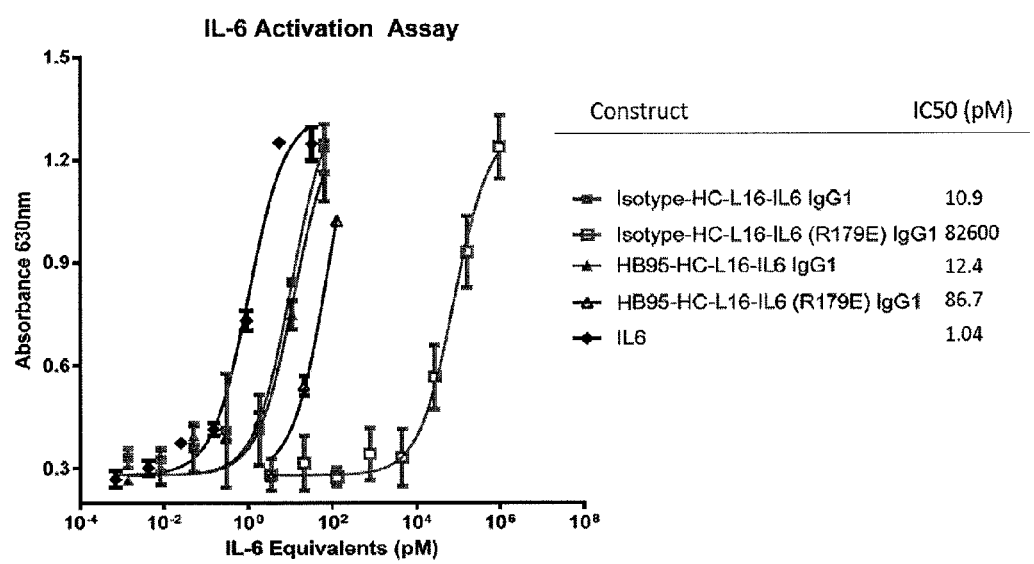
FIG. 46 shows the "IL-6 bioassay" comparing IL-6 with various antibody-IL-6 fusion protein constructs that either do bind to the target cells (based on the HB95 antibody, which binds to class I MHC on the target cells) or do not bind the target cells (based on the isotype control antibody 2D12), fused to either wild type IL-6 or IL-6 with the attenuating R179E mutation. "IL-6 equivalents" refers to the molar concentration of IL-6 molecules, either free or attached to an antibody.

In order to test whether IL-6 can be attenuated and targeted, such that a high Antigen Specificity Index (ASI) may be achieved, IL-6 carrying a 16-mer linker (L16, SGGGGSGGGGSGGGGS, SEQ ID NO:133) at the N-terminus was fused to an antibody targeting class I MHC, using the HB95 antibody (which binds to human class I MHC antigen, as described above) vs. an isotype control antibody, 2D12 (also described above). The non-targeting, isotype control fusion protein construct, 2D12-HC-L16-IL6 IgG1 (composed of SEQ ID NOS:360 (heavy chain) and 344 (light chain)), was compared to free IL-6 in the "IL-6 bioassay" described above (FIG. 46). The antibody fusion showed about 10-fold lower potency than free IL-6 (10.9/1.04=10.5). By introducing the R179E mutation (known to reduce the potency of IL-6; Kalai, Blood 89(4):1319-33, 1997)) into this fusion protein construct, the resulting construct (2D12-HC-L16-IL6(R179E) IgG1, composed of SEQ ID NOS:362 (heavy chain) and 344 (light chain)) was further attenuated, showing a potency 79,400-fold lower than free, wild type IL-6 (82,600/1.04=79,400). By contrast, when the attenuated IL-6 was attached to an antibody (HB95) that binds to an antigen (class I MHC) on the HEK-Blue™ IL-6 cells (HB95-HC-L16-IL-6(R179E) IgG1, composed of SEQ ID NOS:324 (heavy chain) and 312 (light chain)), the potency was increased compared to the non-targeted antibody-attenuated IL-6 fusion protein construct by 953-fold (82,600/86.7=953). This potency is only 6.99-fold lower than that of the targeted, wild type IL-6 fusion protein construct (HB95-HC-L16-IL6 IgG1, composed of SEQ ID NOS:322 (heavy chain) and 312 (light chain); 86.7/12.4=6.99). In other words, in the absence of antibody-antigen targeting and in the context of antibody-IL-6 fusion protein constructs, the R179E mutation reduces the IL-6 potency by 7,580-fold (82,600/10.9=7,580) compared to the mere 6.99-fold in the presence of targeting.

In Vivo Studies of Antibody-Targeted Attenuated IFNα

To confirm that the antibody-attenuated ligand fusion protein constructs of the present invention were active in vivo several experiments, using constructs consisting of antibodies to CD38, which is expressed on the surface of multiple myeloma cells and attenuated versions of IFNα2b, were performed. In most studies this was compared to non-targeted control fusion protein constructs referred to below as "isotype control". The variable regions for the isotype control antibodies were derived from the antibody 2D12 which was raised against the yellow fever virus (Shlesinger, Virology 125: 8-17, 1983).

In the first experiment, a xenograft model in which the multiple myeloma cell line NCI-H929 (ATCC CRL-9068, Gazdar, Blood 67: 1542-1549, 1986) is grown subcutaneously in immunocompromised (SCID) mice was used.

Methods:

Eight to 12 week old CB.17 SCID mice were injected subcutaneously in the flank with 1×10$^7$ NCI-H929 tumor cells in 50% Matrigel. When average tumor size reached 120-150 mm$^3$, mice were grouped into 5 cohorts of 10 mice each and treatment began at time zero (T0). All treatments were given by intraperitoneal injection, (i.p.) twice weekly for 5 weeks (indicated by bar under graph). All compounds were dosed at 200 µg/dose (approximately 10 mg/kg) except for Interferon-α. IFNα2b (Intron A®, Schering Corp., Merck, Whitehouse Station, N.J.) was given at 2 million units/dose. Tumor volume was measured twice weekly by caliper measurement. Endpoint was tumor volume of 2,000 mm$^3$.

Figure 47:
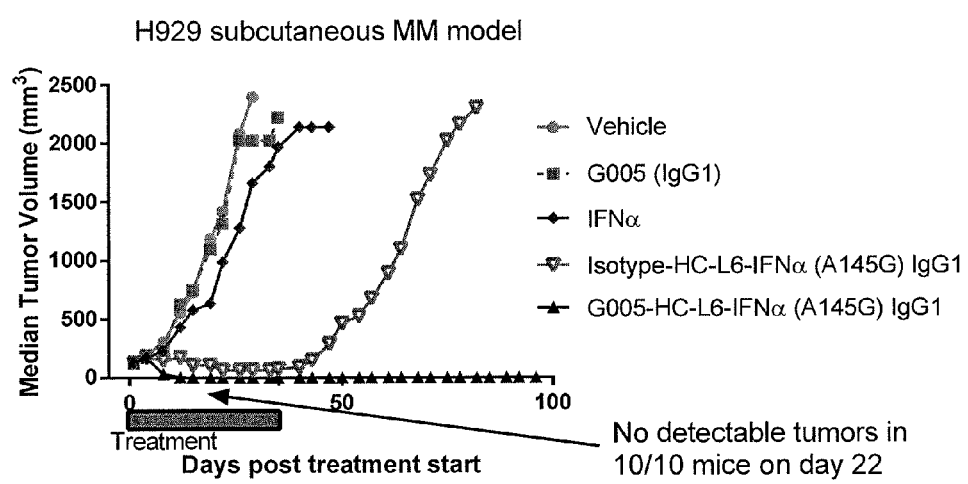
FIG. 47 shows the effects of various compounds on the growth of subcutaneous H929 myeloma tumors in SCID mice. The bar labeled "treatment" shows the duration of treatment with the compounds. The "isotype" antibody was based on antibody 2D12. G005 is an anti-CD38 antibody.

Results:

Results are shown in FIG. 47. Treatment of this multiple myeloma subcutaneous (s.c.) solid tumor with interferon-α (closed diamonds) slightly delayed tumor growth in these mice compared to vehicle (P<0.05, closed circles). Treatment with naked anti-CD38 antibody (G005 IgG1, composed of SEQ ID NOS:135 (heavy chain) and 134 (light chain)), (closed squares) had no significant effect on tumor growth compared to vehicle. All mice in these two groups reached endpoint (2,000 mm$^3$) by day 30. The non-targeted isotype control-attenuated IFNα fusion protein construct (Isotype-HC-L6-IFNα (A145G) IgG1, composed of SEQ ID NOS:348 (heavy chain) and 344 (light chain) (open inverted triangles) did show significant activity in delaying tumor growth, presumably due to the long half-life of the antibody-IFNα fusion protein construct and resulting increased systemic exposure. The CD38-targeted attenuated IFNα fusion protein construct (G005-HC-L6-IFNα (A145G) IgG1, composed of SEQ ID NOS:144 (heavy chain) and 134 (light chain)), by contrast, showed dramatic anti-tumor activity compared to the non-targeted fusion protein construct (P<0.0001) or the other test substances. The targeted anti-CD38-attenuated IFNα fusion protein construct completely resolved tumors in all (10/10) mice to undetectable levels by day 22 with no recurrence throughout the duration of the study.

The anti-CD38-attenuated IFNα fusion protein construct (G005-HC-L6-IFNα (A145G) IgG1) was tested in a systemic multiple myeloma model based on the cell line MM1S (Crown Bioscience Inc., Santa Clara; Greenstein, Exp Hematol. April; 31(4):271-82, 2003).

Methods:

Six to 8 week old NOD-SCID mice were injected intravenously with 1×10$^7$ MM1S tumor cells in 0.1 ml phosphate buffered saline (PBS) 24 hours after irradiation with 200 rad ($^{60}$Co).) Mice were grouped into 4 cohorts of 10 mice each at time zero and treatments began 7 days later. All treatments were given i.p. twice weekly for 9 weeks. All compounds were dosed at 200 µg/dose (approximately 10 mg/kg) except Interferon-α (given at 2 million units/dose). Body weights and overall health were monitored twice weekly and survival was the endpoint.

Figure 48:
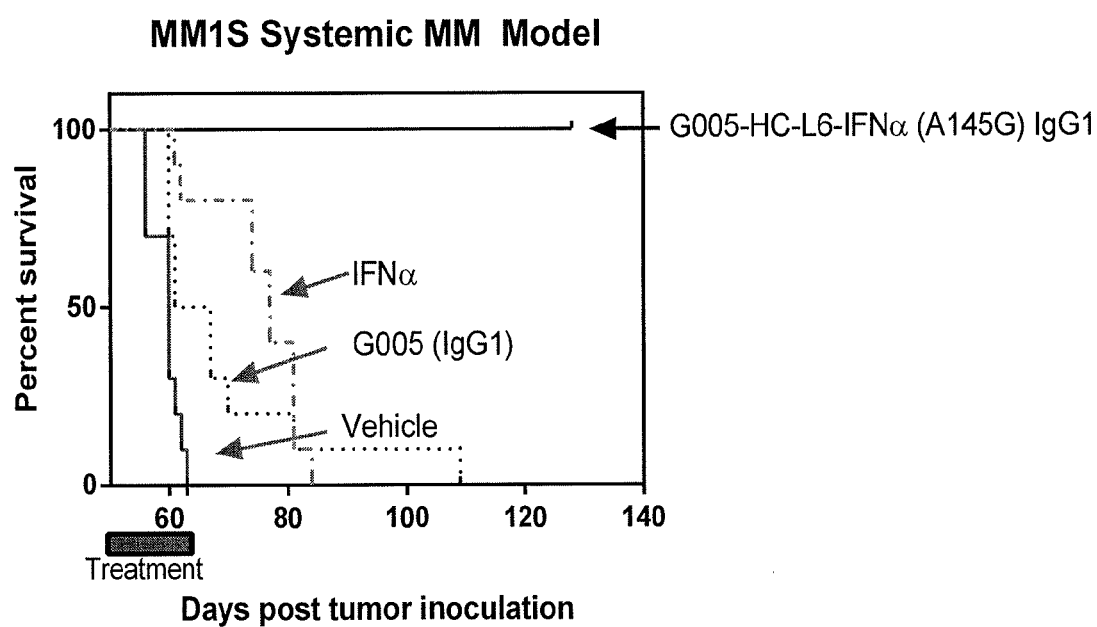
FIG. 48 shows the effects of various compounds on survival (Kaplan-Meier graph) of NOD-SCID mice systemically inoculated with the human myeloma cell line MM1S. The bar labeled "treatment" shows the duration of treatment with the compounds. G005 is an anti-CD38 antibody.

Results:

Results are shown in FIG. 48. Treatment of this systemic multiple myeloma tumor with interferon-α (Intron A) alone increased median survival time (MST) by 18 days compared to vehicle (MST 74 vs 56, respectively.) Treatment with naked anti-CD38 antibody (G005) only slightly increased survival (MST 62 days). None of the mice in the targeted anti-CD38-attenuated IFNα (G005-HC-L6-IFNα (A145G) IgG1) treated cohort showed signs of disease during entire study. All (10/10) mice appeared healthy at termination.

An in vivo study using a third model of cancer, based on the Burkitt's lymphoma cell line Daudi (ATCC CCL-213, Klein, Cancer Res. 28: 1300-1310, 1968) was performed. Daudi cells are CD38$^+$.

Methods:

Six to eight week old NOD-SCID mice were injected subcutaneously in the flank with 1×10$^7$ Daudi Burkitt's Lymphoma tumor cells in 50% Matrigel one day after irradiation with 200 rad ($^{60}$Co). When mean tumor size reached 169 mm$^3$ (Day 20), mice were grouped into 5 cohorts of 10 mice each and treatment began. All treatments were given i.p. twice weekly for 4 weeks. All compounds were dosed at 200 µg/dose (approximately 10 mg/kg) except Interferon-α, which was given at 2 million units (MIU)/dose. Tumor volume was measured twice weekly by caliper measurement. Endpoint was tumor volume of 2,000 mm$^3$.

Figure 49:
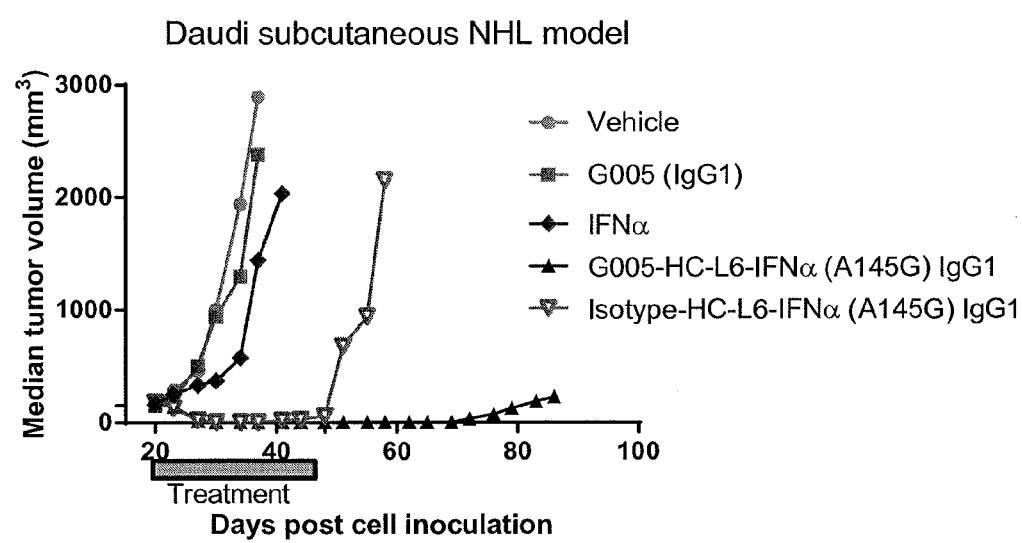
FIG. 49 shows the effects of various compounds on the growth of subcutaneous Daudi lymphoma tumors in NOD-SCID mice. The bar labeled "treatment" shows the duration of treatment with the compounds. The "isotype" antibody was based on antibody 2D12. G005 is an anti-CD38 antibody.

Results:

Results are shown in FIG. 49. Treatment of this Burkitt's lymphoma s.c. tumor with the naked anti-CD38 antibody (closed square) did not significantly delay tumor growth in these mice compared to vehicle (closed circles). The IFNα treatment did result in a significant delay in tumor growth compared to vehicle (5.5 days) however this group reached the 2,000 mm$^3$ endpoint by day 40. The non-targeted isotype control fusion protein construct (Isotype-HC-L6-IFNα (A145G) IgG1; open inverted triangles) showed significant activity in delaying tumor growth but this group reached the 2,000 mm$^3$ endpoint on day 57. As observed in the H929 model (above), this non-targeted activity is most likely due to the extended half-life of the interferon, thereby increasing exposure of the tumor to the cytokine. The targeted anti-CD38-attenuated interferon fusion protein construct (closed triangles) dramatically resolved tumors such that none of the mice had palpable tumors by day 30. Some of the mice in this group, however, did show re-growth of tumors after discontinuation of treatment. Further analysis of this data is presented in Table 36.

TABLE 36

| Treatment | Median Tumor Size (mm3)$^a$ at Day 37 | T/C$^b$ (%) | P value$^c$ |
|---|---|---|---|
| Vehicle | 3034 +/− 340 | — | — |
| Anti-CD38 (G005) IgG1 | 2443 +/− 196 | 81 | 0.575 |
| G005-HC-L6-IFNα (145G) IgG1 | 0 | 0 | <0.0001 |
| Isotype-HC-L6-IFNα (145G) IgG1 | 15 | 0.5 | <0.0001 |
| IFNα | 1440 +/− 154 | 47 | 0.007 |

$^a$Mean +/− SEM
$^b$Ratio of tumor size for treatment group divided by tumor size for vehicle group at day 37
$^c$Vs. vehicle control at day 37

This xenograft experiment shows that the CD38-targeted attenuated IFNα fusion protein constructs may be effective in treating lymphomas in addition to multiple myelomas.

The effect of different doses of the anti-CD38-attenuated IFNα fusion protein construct, were compared to the non-CD38-targeted fusion protein construct, on myeloma tumor growth. For these comparisons, the NCI-H929 s.c. multiple myeloma model was used.

Methods:

Eight to 12 week old CB.17 SCID mice were injected subcutaneously in the flank with 1×10$^7$ NCI-H929 tumor cells in 50% Matrigel. When mean tumor sizes reached 120-150 mm$^3$, mice were grouped into 9 cohorts of 10 mice each and treatment began (time zero). All treatments were given i.p. twice weekly for 5 weeks. Two compounds, targeted anti-CD38-attenuated interferon (closed grey symbols) and non-targeted isotype control-interferon (open symbols), were compared in this study at different doses (see legend for doses). Tumor volume was measured twice weekly by caliper measurement. Endpoint was tumor volume of 2,000 mm$^3$.

Figure 50:
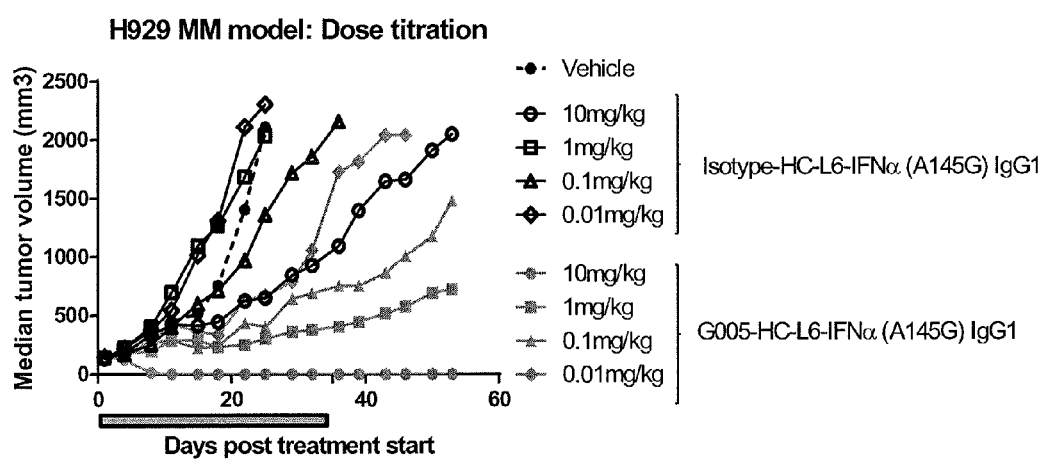
FIG. 50 shows the effects of an anti-CD38-attenuated IFNα fusion protein construct (G005-HC-L6-IFNα (A145G) IgG1) and an isotype control-attenuated IFNα fusion protein construct (Isotype-HC-L6-IFNα (A145G) IgG1) on the growth of subcutaneous H929 myeloma tumors in SCID mice, at various doses. The bar labeled "treatment" shows the duration of treatment with the compounds. The "isotype" antibody was based on antibody 2D12.

Results:

Results are shown in FIG. 50. The dose titration of anti-CD38-targeted attenuated IFNα fusion protein construct (G005-HC-L6-IFNα (A145G) IgG1) demonstrated significant efficacy at all doses of compound tested, even at 0.01 mg/kg. Complete tumor elimination was observed in 10/10 mice only at the highest (10 mg/kg) dose. By contrast, the isotype control-attenuated IFN compound (Isotype-HC-L6-IFNα (A145G) IgG1) showed significant activity only at the highest dose (10 mg/kg). The 0.01 mg/kg dose of the CD38 targeted, attenuated IFN showed similar anti-tumor activity to the isotype control attenuated IFN fusion protein construct at a 1,000-fold higher dose (10 mg/kg), emphasizing the importance of the CD38-targeting.

The next example shows that antibodies of the present invention also include those of the IgG4 isotype.

Methods:

Eight to 12 week old CB.17 SCID mice were injected subcutaneously in the flank with 1×10$^7$ NCI-H929 tumor cells in 50% Matrigel. When average tumor size reached 120-150 mm$^3$, mice were grouped into 5 cohorts of 10 mice each and treatment began (time zero). All treatments were given i.p. twice weekly for 5 weeks. All compounds were dosed at 70 µg/dose (approximately 3.5 mg/kg). Tumor volume was measured twice weekly by caliper measurement. Endpoint was 2,000 mm$^3$.

Figure 51:
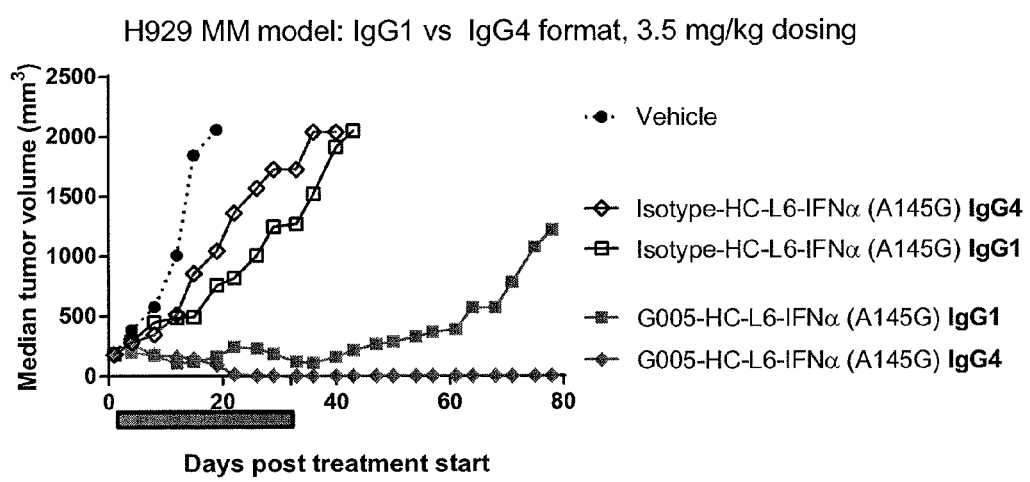
FIG. 51 shows the effects of anti-CD38-attenuated IFNα fusion protein constructs vs isotype control antibody-attenuated IFNα fusion protein constructs, on the growth of subcutaneous H929 myeloma tumors in SCID mice. IgG1 is compared to IgG4 in the context of these fusion protein constructs. The bar labeled "treatment" shows the duration of treatment with the compounds. The "isotype" antibody was based on antibody 2D12.

Results:

Results are shown in FIG. 51. This study compared the activity of the targeted vs. non-targeted fusion protein constructs in two different isotype formats; IgG1 isotype (G005-HC-L6-IFNα (A145G) IgG1 (targeted, closed squares) and Isotype-HC-L6-IFNα (A145G) IgG1 (non-targeted, open squares)) and IgG4 isotype (G005-HC-L6-IFNα (A145G) IgG4, composed of SEQ ID NOS:148 (heavy chain) and 134 (light chain) (targeted, closed diamonds) and Isotype-HC-L6-IFNα (A145G) IgG4, composed of SEQ ID NOS:350 (heavy chain) and 344 (light chain) (non-targeted, open diamonds)) were compared. It is important to note that the mice in this study were treated at a lower dose than in previous studies where we observed 100% tumor elimination. The tumor volumes indicate that, surprisingly, the IgG4 format is more potent than the IgG1 format in this model. Since human IgG1 antibodies have greater effector function than IgG4 antibodies (Hooper, Ann Clin Lab Sci.; 8:201, 1978; Ward, Ther Immunol, 2:77, 1995), it would have been expected that the IgG1 format would have been at least as effective, if not more so, than the IgG4 format. At the end of study, 8/10 mice in the CD38 targeted, attenuated IFN, IgG4 treated group (closed diamonds) were tumor free whereas only 3/10 were tumor-free in the IgG1 format counterpart (closed squares).

The next example extends the observation of in vivo efficacy of an antibody-targeted IFN to a second mutated form of IFNα in which A145 has been mutated to aspartic acid (D). In addition, the experiment below utilizes a different CD38 antibody, i.e. one based on the variable regions of human antibody clone X355/02; (SEQ ID NOS:391 (VH) and 390 (Vλ)). A third difference between this construct and the one presented in the preceding in vivo experiments is that the linker is removed (referred to as "L0"), i.e. the mutated IFNα is fused directly to the C terminus of the antibody heavy chain.

Methods:

Eight to 12 week old CB.17 SCID mice were injected subcutaneously in the flank with 1×10$^7$ NCI-H929 tumor cells in 50% Matrigel. When average tumor size reached 120-150 mm$^3$, mice were grouped into 3 cohorts of 10 mice each and then treatment began (time zero). All treatments were given i.p. twice weekly for 5 weeks. All compounds were dosed at 60 µg/dose (approximately 3 mg/kg). Tumor volume was measured twice weekly by caliper measurement. Endpoint was tumor volume of 2,000 mm$^3$.

Figure 52:
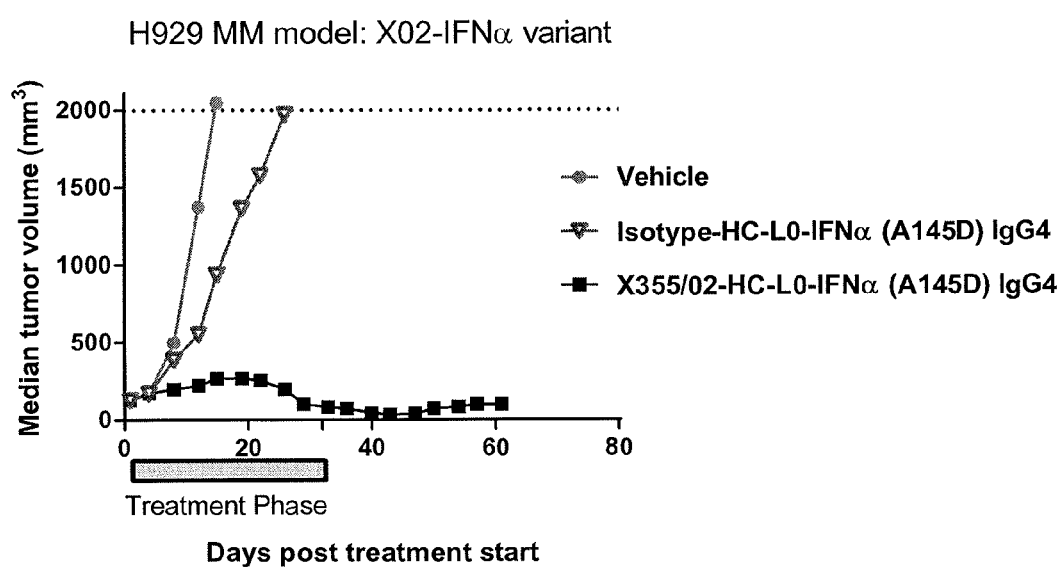
FIG. 52 shows the effects of an anti-CD38-attenuated IFNα fusion protein construct (X355/02-HC-L0-IFNα (A145D) IgG4) vs an isotype control antibody-attenuated IFNα fusion protein constructs on the growth of subcutaneous H929 myeloma tumors in SCID mice. The bar labeled "treatment phase" shows the duration of treatment with the compounds. The "isotype" antibody was based on antibody 2D12.

Results:

Results are shown in FIG. 52. This anti-CD38-attenuated IFNα fusion protein construct (X355/02-HC-L0-IFNα (A145D) IgG4, composed of SEQ ID NOS:232 (heavy chain) and 226 (light chain)) was also very effective in tumor elimination, showing that the ability of anti-CD38-attenuated IFNα fusion protein constructs to effectively treat human myeloma in an in vivo model is not restricted to a single variable domain, IFNα mutation or linker between the antibody and the IFN. The isotype control fusion protein construct showed significantly less anti-myeloma activity, consistent with the CD38-based targeting.

The next example shows that an anti-CD38 antibody-attenuated IFNα fusion protein construct is more effective than standard drugs used to treat multiple myeloma in the same xenograft model described above.

Methods:

Eight to 12 week old CB.17 SCID mice were injected subcutaneously in the flank with 1×10$^7$ NCI-H929 tumor cells in 50% Matrigel. When mean tumor sizes reached 120-150 mm$^3$, mice were grouped into cohorts of 10 mice each and treatment began (time zero). Treatments were administered at doses and regimens described in legend. Tumor volume was measured twice weekly by caliper measurement. Endpoint was 2,000 mm$^3$.

Figure 53:
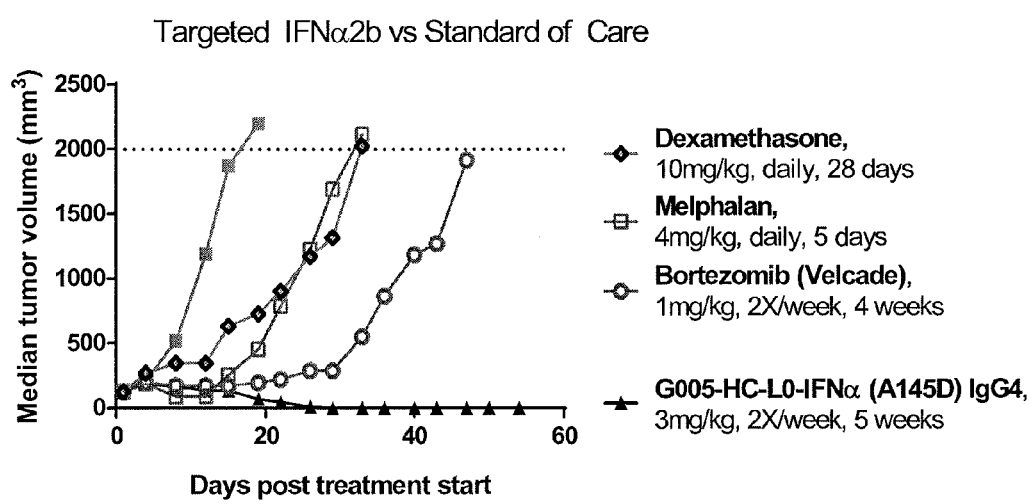
FIG. 53 shows the effects of various compounds on the growth of subcutaneous H929 myeloma tumors in SCID mice. G005 is an anti-CD38 antibody.

Results:

Results are shown in FIG. 53. In this study the activity of the anti-CD38 targeted fusion protein construct (G005-HC-L0-IFNα (A145D) IgG4, composed of SEQ ID NOS:180 (heavy chain) and 134 (light chain)) was compared with standard therapies Bortezomib (Velcade), Melphalan (Alkeran), and Dexamethasone. Of the anti-CD38 targeted, attenuated interferon group, 8/10 were tumor free at day 60 (closed triangles), whereas all mice in the other groups had reached endpoint by day 50.

The next example shows that an anti-CD38-attenuated IFN fusion protein construct can completely eliminate established human multiple myeloma tumors in a mouse model, even when the fusion protein construct is given as a single dose.

Methods:

Eight to 12 week old CB.17 SCID mice were injected subcutaneously in the flank with 1×10$^7$ NCI-H929 tumor cells in 50% Matrigel. When mean tumor sizes reached 120-150 mm$^3$ mice were grouped into cohorts of 10 mice each and then treatment began (T0). Treatments with the anti-CD38 antibody-attenuated Interferon fusion protein construct were administered according to following regimens: single dose on day 0 (closed triangles), two doses (on day 0 and day 3; closed squares), 4 doses (on days 0, 3, 8, and 11; closed diamonds) and 6 doses (on days 0, 3, 8, 11, 15 and 18; closed black circles). One cohort received 6 doses of the isotype control-attenuated interferon fusion protein construct on days 0, 3, 8, 11, and 18 (open squares). The vehicle treatment group is shown in grey filled circles. Tumor volume was measured twice weekly by caliper measurement. Endpoint was 2,000 mm$^3$.

Figure 54:
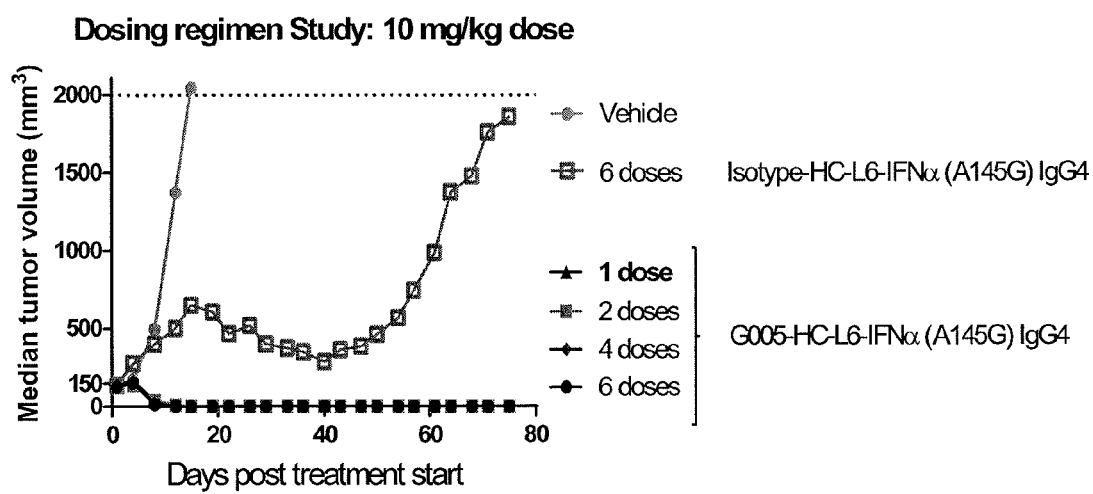
FIG. 54 shows the effects of an anti-CD38-attenuated IFNα fusion protein construct (G005-HC-L6-IFNα (A145G) IgG4) and an isotype control-attenuated IFNα fusion protein construct (Isotype-HC-L6-IFNα (A145G) IgG4) on the growth of subcutaneous H929 myeloma tumors in SCID mice, with several rounds of administration each at a dose of 10 mg/kg. The "isotype" antibody was based on antibody 2D12.

Results:

Results are shown in FIG. 54. This study surprisingly showed that a single dose of the G005-HC-L6-IFNα (A145G) IgG4 fusion protein construct was sufficient to eliminate established tumors in all 10/10 mice by day 15; furthermore, by day 60, no tumors had re-grown in any of the mice in this single dose group. This was true of all 4 dosing regimens with the targeted attenuated interferon. The isotype control group was only tested at the 6 dose regimen and showed considerably less activity. That a single dose of a compound can effectively cure animals of established multiple myeloma tumors is unprecedented and extremely surprising since anti-tumor therapies are typically dosed multiple times in order to observe efficacy.

The next example demonstrates that even very large tumors can be eliminated by treatment with an anti-CD38-attenuated IFN fusion protein construct.

Methods:

One cohort (n=9) from the immediately preceding study was not treated until the mean tumor volume reached 730 mm$^3$. This cohort then received 6 doses of anti-CD38 targeted, attenuated interferon on days 12, 15, 19, 22, 26 and 29 (arrows).

Figure 55:
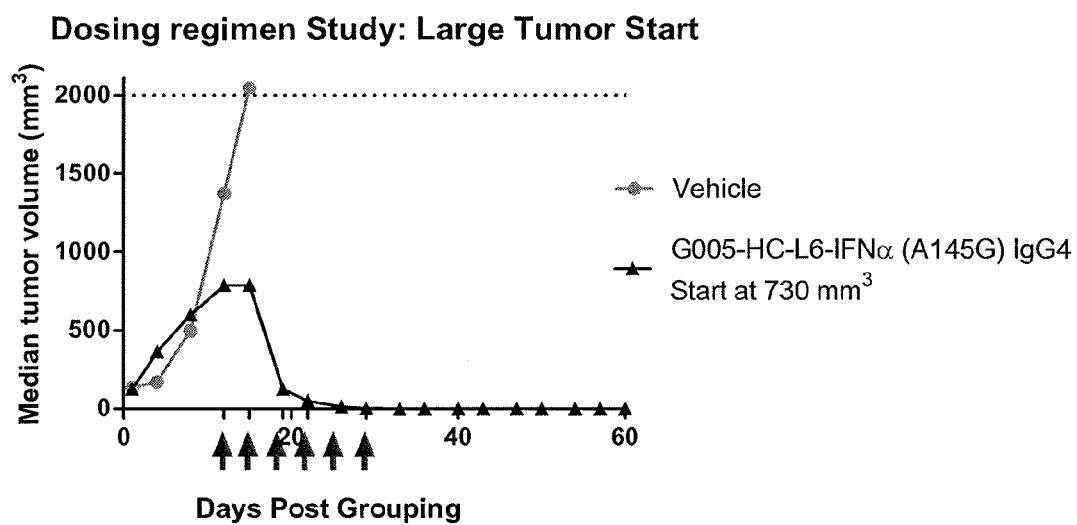
FIG. 55 shows the effects of an anti-CD38-attenuated IFNα fusion protein construct (G005-HC-L6-IFNα (A145G) IgG4) on the growth of subcutaneous H929 myeloma tumors in SCID mice. Dosing (indicated by arrows) was initiated when the median tumor volume reached 730 mm$^3$.

Results:

Results are shown in FIG. 55. 8/9 mice in this cohort showed complete tumor elimination by day 30 and no tumors had re-appeared in any of these mice by end of the study. Three of these mice had starting tumors >1000 mm$^3$. The only mouse that died from the myeloma was one which had a tumor volume of 1,800 mm$^3$ at the start of treatment;

it reached the 2,000 mm³ endpoint on the following day. This result is very surprising and no other compound has been reported to eliminate myeloma tumors of this size in any animal model.

It was shown that in the in vitro experiments above (Table 27) that the G005-HC-L6-IFNα (A145G) IgG4 fusion protein construct has about 25,000-fold lower potency than free, wild-type IFNα2b under conditions where the antibody does not target the attenuated IFNα to the cells being tested (off target assay). The following experiments aimed to determine if the fusion protein construct also showed dramatic attenuation of IFN activity in an ex vivo assay of IFN activity that is relevant to the toxicity of IFNα. This effect of IFNα on hematopoiesis can be measured ex vivo by determining the effect of IFNα on the number of colony forming units derived from primary human bone marrow mononuclear cells. The IFNα vs. the antibody-attenuated IFNα fusion protein constructs were compared in terms of their effect on colony formation.

Methods:

Frozen normal human bone marrow mononuclear cells (AllCells, Inc., Emeryville, Calif.) from 3 donors were thawed in RPMI-1640 medium plus 10% fetal bovine serum (FBS) (complete medium) and washed with same medium two times. After washing, cells were kept in this medium at $1.75 \times 10^6$ cells/ml. Cell suspensions were diluted with MethoCult H4434 Classic medium (Stem Cell Technologies, Cat#04434) to a final cell concentration of $0.7 \times 10^5$ cells/ml. Cells were then mixed very well and 3 ml of this mixture was aliquoted into each tube.

Intron A (Schering Corp. Merck, N.J.) and fusion protein constructs (G005-HC-L0-IFNα (145D) IgG4 and Isotype-HC-L0-IFNα (145D) IgG4) were diluted in tenfold serial dilutions in complete medium and 150 μl of each dilution was added to tubes containing the 3 ml of the bone marrow cells in the Methocult H4434 medium. Mixtures were plated at 1.1 ml per 35 mm tissue culture dish (Stem Cell Technologies, cat#27115). Plates were then incubated in a well-humidified incubator at 37° C. with 5% CO₂ for two weeks. Colonies were counted on a microscope using a gridded scoring dish (Stem Cell Technologies, Cat#27500) and the number of colonies/plate was recorded. Percent colony recovery for a given test substance was calculated by dividing the number of colonies per plate by the number of colonies in the plates with no added test substance. A total of three human bone marrow MNC were tested using this method.

Figure 56:
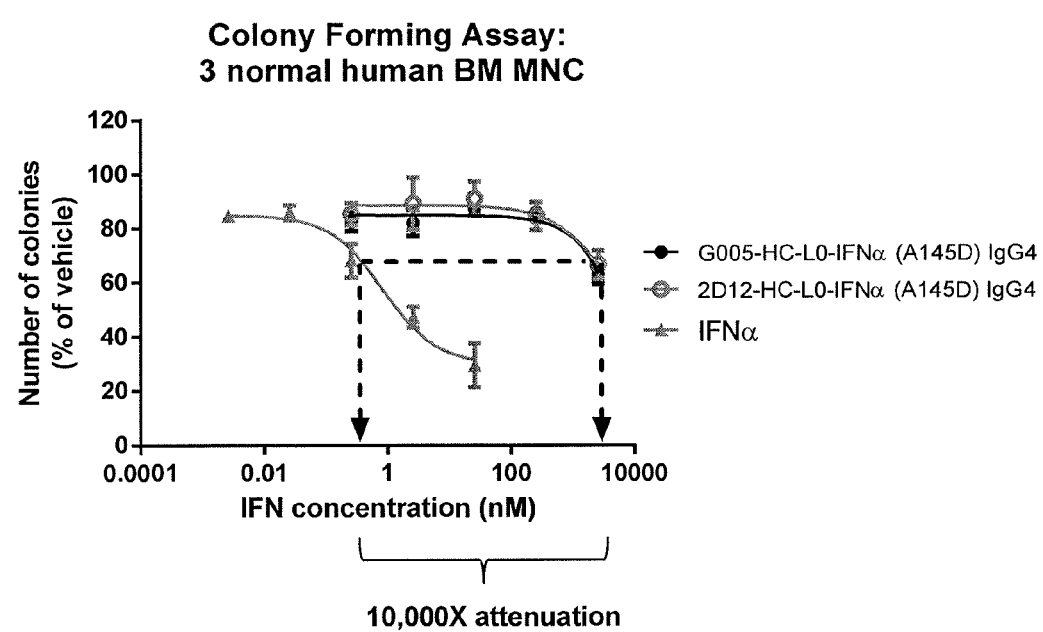
FIG. 56 shows the inhibition of colony formation from normal human bone marrow mononuclear cells (BM MNC) by IFNa2b, an anti-CD38-attenuated IFNα fusion protein construct (G005-HC-L0-IFNα (A145D) IgG4) and an isotype control antibody-attenuated IFNα fusion protein construct 2D12-HC-L0-IFNα (A145D) IgG4. The antibody-attenuated IFNα fusion protein constructs show about 10,000-fold reduced potency in this assay.

Results:

The results are shown in FIG. 56. The data indicate that both the targeted (anti-CD38, G005) and the non-targeted (isotype; 2D12) attenuated interferon fusion protein constructs had similar activity, indicating that the CD38 expression observed on normal bone marrow cells is not likely expressed on the colony forming cells since very little inhibition of colony formation was observed with the targeted treatment. Both fusion protein constructs had approximately 10,000× fold less activity in inhibiting colony formation than wild type, free IFNα, thus confirming that the A145D mutation attenuates the IFN activity of the antibody-IFNα fusion protein constructs and suggesting that such attenuated IFN-antibody fusion protein constructs will have a superior safety profile compared to IFNα itself.

Another activity of IFNα that can be measured ex vivo is the stimulation of cytokine and chemokine secretion. Normal human PBMCs were stimulated with various concentrations of IFNα vs the antibody-attenuated IFNα fusion protein construct Isotype-HC-L6-IFNα (A145G) IgG1 (based on the 2D12 antibody), and measured the resulting cytokine production.

Methods:

Normal human peripheral blood mononuclear cells (PBMC) from four normal donors were washed with Xvivo-15 medium (Lonza, Cat#04-418Q) and resuspended in the same medium at a cell density of $1 \times 10^6$ cells/ml. The cells were then incubated with human IgG at 4 mg/ml and incubated at 37° C. for 30 min to block any nonspecific IgG binding. Without washing, 250 μl aliquots of cells were then added to wells of 24-well tissue culture treated plates. To these wells were then added 250 μl of free IFNα or an IgG-attenuated IFNα fusion protein construct (Isotype-HC-L6-IFNα (A145G) IgG1; isotype antibody is 2D12) at various concentrations. Plates were then incubated overnight at 37° C. in 5% CO₂. The following day, the plates were spun down and 200 μl of supernatant was collected from each well. Supernatants were kept frozen until analysis using a Luminex cytokine assay.

Luminex Assay: Using the Premix 42-plex from Millipore (Cat#MPXHCYTO60KPMX42) we were able to measure the level of human cytokines produced by the PBMCs stimulated by the test substances. The culture supernatants were incubated with the pre-mixed polystyrene microbeads that were coated with anti-cytokine antibodies according to the manufacturer's instructions. After washing, the biotinylated detection antibody cocktail was introduced to the bead-captured analyte. Finally the reaction mixture was incubated with Streptavidin PE and the fluorescent intensity of PE was measured on the Luminex analyzer. Results were interpolated by the standard curve constructed based on the controls provided in the kit.

Figure 57A:
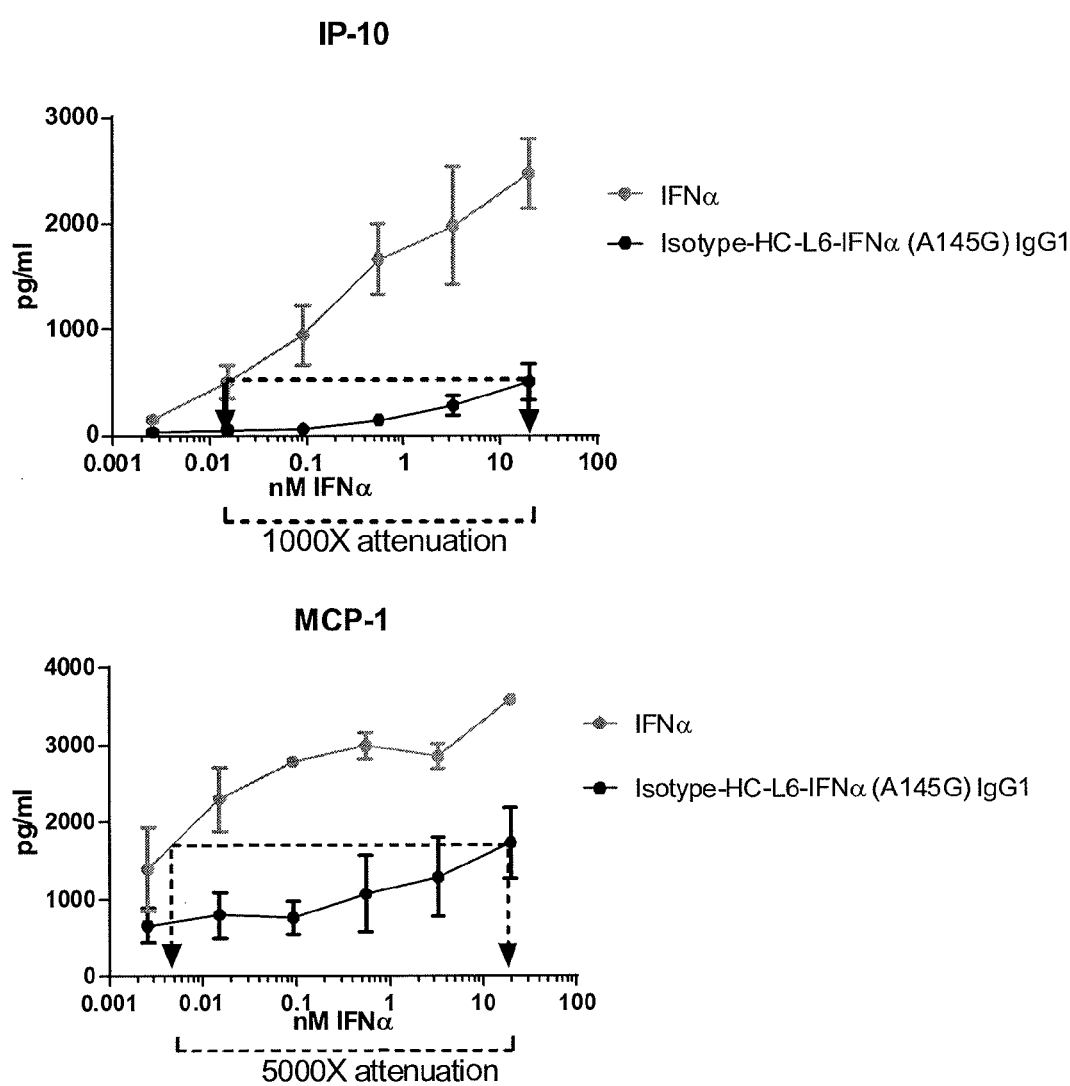
FIG. 57 shows the effects of IFNα2b vs an antibody-attenuated IFNα fusion protein construct (Isotype-HC-L6-IFNα (A145G) IgG1; the isotype variable regions are based on antibody 2D12) on cytokine production by human peripheral blood mononuclear cells (PBMCs). (a) IP-10 and MCP-1; (b) MCP-3 and IL-1α.
Figure 57B:
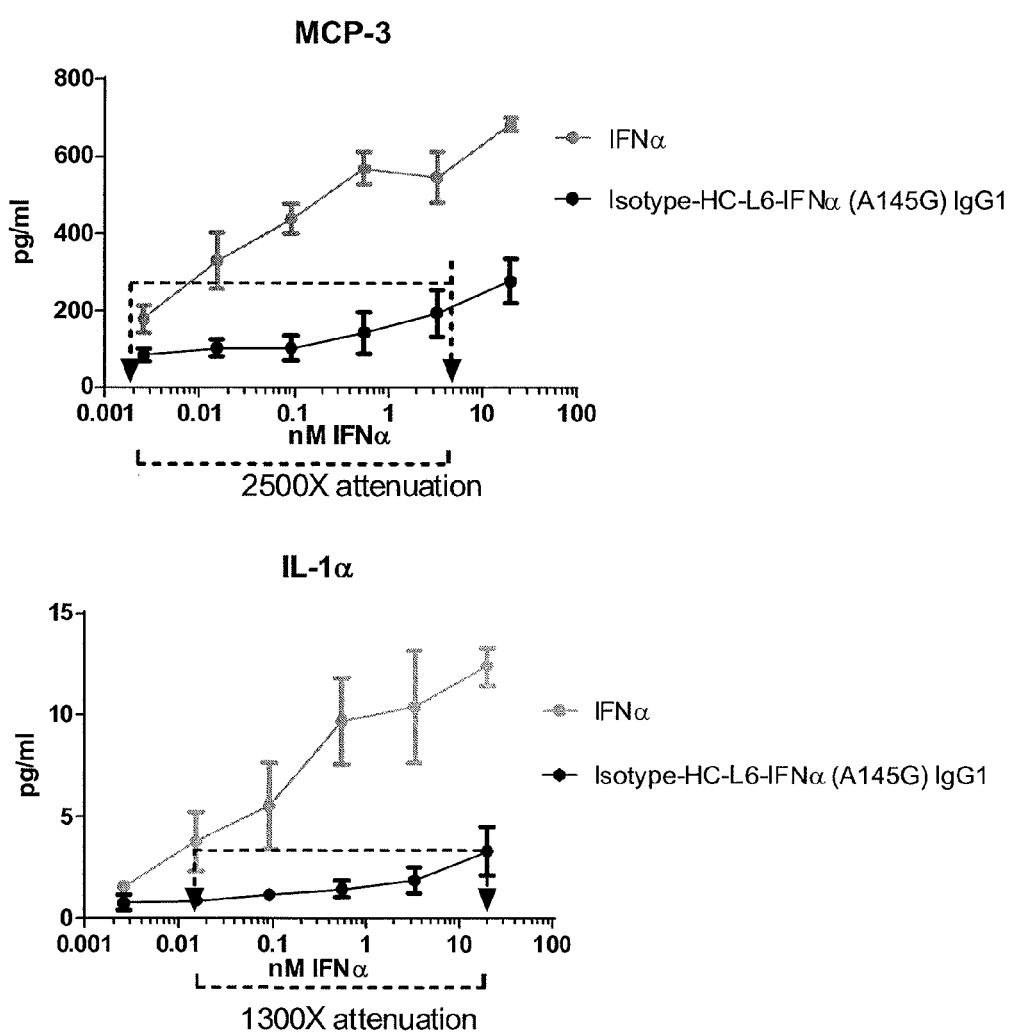

Results:

Results are shown in FIG. 57. Four cytokines (IP-10, MCP-1, MCP-3 and IL-1α) were consistently upregulated in response to IFNα exposure. The antibody-attenuated IFNα fusion protein construct (Isotype-HC-L6-IFNα (A145G) IgG1) showed 1,000-5,000-fold reduced potency compared to wild type IFNα stimulation. This confirms that the mutation did result in a significant attenuation of biological activity. Panel (a) shows the dose-response curves for IP-10 (estimated at ~1,000-fold attenuation) and MCP-1 (estimated at about 5,000-fold attenuation); panel (b) shows the dose-response curves for MCP-3 (estimated at ~2,500-fold attenuation) and IL1α (estimated at about 1,300-fold attenuation).

Sequence Tables

TABLE 37

Single polypeptide chain sequences

| SEQ ID NO: | Species | Length | Unit | Gene | Subtype | Variant |
|---|---|---|---|---|---|---|
| 1 | human | 166 | aa | IFN | α1b | native |
| 2 | human | 165 | aa | IFN | α2a | native |
| 3 | human | 165 | aa | IFN | α2b | native |

TABLE 37-continued

Single polypeptide chain sequences

| SEQ ID NO: | Species | Length | Unit | Gene | Subtype | Variant |
|---|---|---|---|---|---|---|
| 4 | human | 165 | aa | IFN | α2b | L15A |
| 5 | human | 165 | aa | IFN | α2b | A19W |
| 6 | human | 165 | aa | IFN | α2b | R22A |
| 7 | human | 165 | aa | IFN | α2b | R23A |
| 8 | human | 165 | aa | IFN | α2b | S25A |
| 9 | human | 165 | aa | IFN | α2b | L26A |
| 10 | human | 165 | aa | IFN | α2b | F27A |
| 11 | human | 165 | aa | IFN | α2b | L30A |
| 12 | human | 165 | aa | IFN | α2b | L30V |
| 13 | human | 165 | aa | IFN | α2b | K31A |
| 14 | human | 165 | aa | IFN | α2b | D32A |
| 15 | human | 165 | aa | IFN | α2b | R33K |
| 16 | human | 165 | aa | IFN | α2b | R33A |
| 17 | human | 165 | aa | IFN | α2b | R33Q |
| 18 | human | 165 | aa | IFN | α2b | H34A |
| 19 | human | 165 | aa | IFN | α2b | Q40A |
| 20 | human | 165 | aa | IFN | α2b | D114R |
| 21 | human | 165 | aa | IFN | α2b | L117A |
| 22 | human | 165 | aa | IFN | α2b | R120A |
| 23 | human | 165 | aa | IFN | α2b | R120E |
| 24 | human | 165 | aa | IFN | α2b | R125A |
| 25 | human | 165 | aa | IFN | α2b | R125E |
| 26 | human | 165 | aa | IFN | α2b | K131A |
| 27 | human | 165 | aa | IFN | α2b | E132A |
| 28 | human | 165 | aa | IFN | α2b | K133A |
| 29 | human | 165 | aa | IFN | α2b | K134A |
| 30 | human | 165 | aa | IFN | α2b | R144A |
| 31 | human | 165 | aa | IFN | α2b | R144D |
| 32 | human | 165 | aa | IFN | α2b | R144E |
| 33 | human | 165 | aa | IFN | α2b | R144G |
| 34 | human | 165 | aa | IFN | α2b | R144H |
| 35 | human | 165 | aa | IFN | α2b | R144I |
| 36 | human | 165 | aa | IFN | α2b | R144K |
| 37 | human | 165 | aa | IFN | α2b | R144L |
| 38 | human | 165 | aa | IFN | α2b | R144N |
| 39 | human | 165 | aa | IFN | α2b | R144Q |
| 40 | human | 165 | aa | IFN | α2b | R144S |
| 41 | human | 165 | aa | IFN | α2b | R144T |
| 42 | human | 165 | aa | IFN | α2b | R144V |
| 43 | human | 165 | aa | IFN | α2b | R144Y |
| 44 | human | 165 | aa | IFN | α2b | A145D |
| 45 | human | 165 | aa | IFN | α2b | A145E |
| 46 | human | 165 | aa | IFN | α2b | A145G |
| 47 | human | 165 | aa | IFN | α2b | A145H |
| 48 | human | 165 | aa | IFN | α2b | A145I |
| 49 | human | 165 | aa | IFN | α2b | A145K |
| 50 | human | 165 | aa | IFN | α2b | A145L |
| 51 | human | 165 | aa | IFN | α2b | A145M |
| 52 | human | 165 | aa | IFN | α2b | A145N |
| 53 | human | 165 | aa | IFN | α2b | A145Q |
| 54 | human | 165 | aa | IFN | α2b | A145R |
| 55 | human | 165 | aa | IFN | α2b | A145S |
| 56 | human | 165 | aa | IFN | α2b | A145T |
| 57 | human | 165 | aa | IFN | α2b | A145V |
| 58 | human | 165 | aa | IFN | α2b | A145Y |
| 59 | human | 165 | aa | IFN | α2b | M148A |
| 60 | human | 165 | aa | IFN | α2b | R149A |
| 61 | human | 165 | aa | IFN | α2b | S152A |
| 62 | human | 165 | aa | IFN | α2b | L153A |
| 63 | human | 165 | aa | IFN | α2b | N156A |
| 64 | human | 165 | aa | IFN | α2b | L30A + YNS |
| 65 | human | 165 | aa | IFN | α2b | R33A + YNS |
| 66 | human | 165 | aa | IFN | α2b | M148A + YNS |
| 67 | human | 165 | aa | IFN | α2b | L153A + YNS |
| 68 | human | 165 | aa | IFN | α2b | R144A + YNS |
| 69 | human | 165 | aa | IFN | α2b | N65A, L80A, Y85A, Y89A |
| 70 | human | 165 | aa | IFN | α2b | N65A, L80A, Y85A, Y89A, D114A |
| 71 | human | 165 | aa | IFN | α2b | N65A, L80A, Y85A, Y89A, L117A |
| 72 | human | 165 | aa | IFN | α2b | N65A, L80A, Y85A, Y89A, R120A |
| 73 | human | 165 | aa | IFN | α2b | Y85A, Y89A, R120A |
| 74 | human | 165 | aa | IFN | α2b | D114A, R120A |
| 75 | human | 165 | aa | IFN | α2b | L117A, R120A |
| 76 | human | 165 | aa | IFN | α2b | L117A, R120A, K121A |
| 77 | human | 165 | aa | IFN | α2b | R120A, K121A |
| 78 | human | 165 | aa | IFN | α2b | R120E, K121E |

TABLE 37-continued

Single polypeptide chain sequences

| SEQ ID NO: | Species | Length | Unit | Gene | Subtype | Variant |
|---|---|---|---|---|---|---|
| 79 | human | 160 | aa | IFN | α2b | Δ[L161-E165] |
| 80 | human | 166 | aa | IFN | α4b | native |
| 81 | human | 166 | aa | IFN | α5 | native |
| 82 | human | 166 | aa | IFN | α6 | native |
| 83 | human | 166 | aa | IFN | α7 | native |
| 84 | human | 166 | aa | IFN | α8 | native |
| 85 | human | 166 | aa | IFN | α10 | native |
| 86 | human | 166 | aa | IFN | α1a/13 | native |
| 87 | human | 166 | aa | IFN | α14 | native |
| 88 | human | 166 | aa | IFN | α16 | native |
| 89 | human | 166 | aa | IFN | α17 | native |
| 90 | human | 166 | aa | IFN | α21 | native |
| 91 | human | 166 | aa | IFN | β1(a) | native |
| 92 | human | 166 | aa | IFN | β1(a) | R27A |
| 93 | human | 166 | aa | IFN | β1(a) | R35T |
| 94 | human | 166 | aa | IFN | β1(a) | E42K |
| 95 | human | 166 | aa | IFN | β1(a) | D54N |
| 96 | human | 166 | aa | IFN | β1(a) | M62I |
| 97 | human | 166 | aa | IFN | β1(a) | G78S |
| 98 | human | 166 | aa | IFN | β1(a) | K123A |
| 99 | human | 166 | aa | IFN | β1(a) | C141Y |
| 100 | human | 166 | aa | IFN | β1(a) | A142T |
| 101 | human | 166 | aa | IFN | β1(a) | E149K |
| 102 | human | 166 | aa | IFN | β1(a) | R152H |
| 103 | human | 166 | aa | IFN | β1(b) | C17S |
| 104 | human | 166 | aa | IFN | β1(b) | C17S, R35A |
| 105 | human | 166 | aa | IFN | β1(b) | C17S, R147A |
| 106 | human | 143 | aa | IFN | γ | native |
| 107 | human | 143 | aa | IFN | γ | S20I |
| 108 | human | 143 | aa | IFN | γ | S20C |
| 109 | human | 143 | aa | IFN | γ | D21K |
| 110 | human | 143 | aa | IFN | γ | V22D |
| 111 | human | 143 | aa | IFN | γ | A23Q |
| 112 | human | 143 | aa | IFN | γ | A23V |
| 113 | human | 143 | aa | IFN | γ | D24A |
| 114 | human | 141 | aa | IFN | γ | Δ[A23, D24] |
| 115 | human | 141 | aa | IFN | γ | Δ[N25, G26] |
| 116 | human | 122 | aa | IFN | γ | Δ[A123-Q143] |
| 117 | human | 129 | aa | IFN | γ | Δ[K130-Q143] |
| 118 | human | 132 | aa | IFN | γ | Δ[K130, R131, L135-Q143] |
| 119 | human | 129 | aa | IL-4 | | native |
| 120 | human | 129 | aa | IL-4 | | E9K |
| 121 | human | 129 | aa | IL-4 | | R88D |
| 122 | human | 129 | aa | IL-4 | | R88Q |
| 123 | human | 184 | aa | IL-6 | | native |
| 124 | human | 184 | aa | IL-6 | | F74E |
| 125 | human | 184 | aa | IL-6 | | F78E |
| 126 | human | 184 | aa | IL-6 | | R179E |
| 127 | human | 310 | aa | CD38 | human | tagged, ECD |
| 128 | cynomolgus | 310 | aa | CD38 | cynomolgus | tagged, ECD |
| 129 | human | 774 | nucleotide (coding strand) | CD38 | human | ECD, for genetic immunisation (DNA) |
| 130 | human | 258 | aa | CD38 | human | ECD, for genetic immunisation (translated) |
| 131 | human | 300 | aa | CD38 | human | native |
| 132 | synthetic | 6 | aa | linker | | 6-mer |
| 133 | synthetic | 16 | aa | linker | | 16-mer |

TABLE 38

SEQ ID NOs related to proteins comprising 2 polypeptide chains

| SEQ ID NO: | Protein Name | Chain | Species | Length | Unit |
|---|---|---|---|---|---|
| 134 | G005 IgG1 | LC aa | human | 214 | aa |
| 135 | | HC aa | human | 452 | aa |
| 136 | | LC DNA | human | 642 | nucleotide (coding strand) |
| 137 | | HC DNA | human | 1356 | nucleotide (coding strand) |

TABLE 38-continued

SEQ ID NOs related to proteins comprising 2 polypeptide chains

| SEQ ID NO: | Protein Name | Chain | Species | Length | Unit |
|---|---|---|---|---|---|
| 134 | G005-HC-L0-IFNα(R144A) IgG1 | LC aa | human | 214 | aa |
| 138 | | HC aa | synthetic | 617 | aa |
| 136 | | LC DNA | human | 642 | nucleotide (coding strand) |
| 139 | | HC DNA | synthetic | 1851 | nucleotide (coding strand) |
| 134 | G005-HC-L6-IFNα(R144A) IgG1 | LC aa | human | 214 | aa |
| 140 | | HC aa | synthetic | 623 | aa |
| 136 | | LC DNA | human | 642 | nucleotide (coding strand) |
| 141 | | HC DNA | synthetic | 1869 | nucleotide (coding strand) |
| 134 | G005-HC-L0-IFNα(A145G) IgG1 | LC aa | human | 214 | aa |
| 142 | | HC aa | synthetic | 617 | aa |
| 136 | | LC DNA | human | 642 | nucleotide (coding strand) |
| 143 | | HC DNA | synthetic | 1851 | nucleotide (coding strand) |
| 134 | G005-HC-L6-IFNα(A145G) IgG1 | LC aa | human | 214 | aa |
| 144 | | HC aa | synthetic | 623 | aa |
| 136 | | LC DNA | human | 642 | nucleotide (coding strand) |
| 145 | | HC DNA | synthetic | 1869 | nucleotide (coding strand) |
| 134 | G005-HC-L6-IFNα(R144A) IgG4 | LC aa | human | 214 | aa |
| 146 | | HC aa | synthetic | 620 | aa |
| 136 | | LC DNA | human | 642 | nucleotide (coding strand) |
| 147 | | HC DNA | synthetic | 1860 | nucleotide (coding strand) |
| 134 | G005-HC-L6-IFNα(A145G) IgG4 | LC aa | human | 214 | aa |
| 148 | | HC aa | synthetic | 620 | aa |
| 136 | | LC DNA | human | 642 | nucleotide (coding strand) |
| 149 | | HC DNA | synthetic | 1860 | nucleotide (coding strand) |
| 134 | G005-HC-L0-IFNα IgG4 | LC aa | human | 214 | aa |
| 150 | | HC aa | synthetic | 614 | aa |
| 136 | | LC DNA | human | 642 | nucleotide (coding strand) |
| 151 | | HC DNA | synthetic | 1842 | nucleotide (coding strand) |
| 134 | G005-HC-L0-IFNα(R144A) IgG4 | LC aa | human | 214 | aa |
| 152 | | HC aa | synthetic | 614 | aa |
| 136 | | LC DNA | human | 642 | nucleotide (coding strand) |
| 153 | | HC DNA | synthetic | 1842 | nucleotide (coding strand) |
| 134 | G005-HC-L0-IFNα(R144D) IgG4 | LC aa | human | 214 | aa |
| 154 | | HC aa | synthetic | 614 | aa |
| 136 | | LC DNA | human | 642 | nucleotide (coding strand) |
| 155 | | HC DNA | synthetic | 1842 | nucleotide (coding strand) |
| 134 | G005-HC-L0-IFNα(R144E) IgG4 | LC aa | human | 214 | aa |
| 156 | | HC aa | synthetic | 614 | aa |
| 136 | | LC DNA | human | 642 | nucleotide (coding strand) |
| 157 | | HC DNA | synthetic | 1842 | nucleotide (coding strand) |
| 134 | G005-HC-L0-IFNα(R144G) IgG4 | LC aa | human | 214 | aa |
| 158 | | HC aa | synthetic | 614 | aa |
| 136 | | LC DNA | human | 642 | nucleotide (coding strand) |
| 159 | | HC DNA | synthetic | 1842 | nucleotide (coding strand) |
| 134 | G005-HC-L0-IFNα(R144H) IgG4 | LC aa | human | 214 | aa |
| 160 | | HC aa | synthetic | 614 | aa |
| 136 | | LC DNA | human | 642 | nucleotide (coding strand) |
| 161 | | HC DNA | synthetic | 1842 | nucleotide (coding strand) |
| 134 | G005-HC-L0-IFNα(R144I) IgG4 | LC aa | human | 214 | aa |
| 162 | | HC aa | synthetic | 614 | aa |

TABLE 38-continued

SEQ ID NOs related to proteins comprising 2 polypeptide chains

| SEQ ID NO: | Protein Name | Chain | Species | Length | Unit |
|---|---|---|---|---|---|
| 136 | | LC DNA | human | 642 | nucleotide (coding strand) |
| 163 | | HC DNA | synthetic | 1842 | nucleotide (coding strand) |
| 134 | G005-HC-L0-IFNα(R144K) IgG4 | LC aa | human | 214 | aa |
| 164 | | HC aa | synthetic | 614 | aa |
| 136 | | LC DNA | human | 642 | nucleotide (coding strand) |
| 165 | | HC DNA | synthetic | 1842 | nucleotide (coding strand) |
| 134 | G005-HC-L0-IFNα(R144L) IgG4 | LC aa | human | 214 | aa |
| 166 | | HC aa | synthetic | 614 | aa |
| 136 | | LC DNA | human | 642 | nucleotide (coding strand) |
| 167 | | HC DNA | synthetic | 1842 | nucleotide (coding strand) |
| 134 | G005-HC-L0-IFNα(R144N) IgG4 | LC aa | human | 214 | aa |
| 168 | | HC aa | synthetic | 614 | aa |
| 136 | | LC DNA | human | 642 | nucleotide (coding strand) |
| 169 | | HC DNA | synthetic | 1842 | nucleotide (coding strand) |
| 134 | G005-HC-L0-IFNα(R144Q) IgG4 | LC aa | human | 214 | aa |
| 170 | | HC aa | synthetic | 614 | aa |
| 136 | | LC DNA | human | 642 | nucleotide (coding strand) |
| 171 | | HC DNA | synthetic | 1842 | nucleotide (coding strand) |
| 134 | G005-HC-L0-IFNα(R144S) IgG4 | LC aa | human | 214 | aa |
| 172 | | HC aa | synthetic | 614 | aa |
| 136 | | LC DNA | human | 642 | nucleotide (coding strand) |
| 173 | | HC DNA | synthetic | 1842 | nucleotide (coding strand) |
| 134 | G005-HC-L0-IFNα(R144T) IgG4 | LC aa | human | 214 | aa |
| 174 | | HC aa | synthetic | 614 | aa |
| 136 | | LC DNA | human | 642 | nucleotide (coding strand) |
| 175 | | HC DNA | synthetic | 1842 | nucleotide (coding strand) |
| 134 | G005-HC-L0-IFNα(R144V) IgG4 | LC aa | human | 214 | aa |
| 176 | | HC aa | synthetic | 614 | aa |
| 136 | | LC DNA | human | 642 | nucleotide (coding strand) |
| 177 | | HC DNA | synthetic | 1842 | nucleotide (coding strand) |
| 134 | G005-HC-L0-IFNα(R144Y) IgG4 | LC aa | human | 214 | aa |
| 178 | | HC aa | synthetic | 614 | aa |
| 136 | | LC DNA | human | 642 | nucleotide (coding strand) |
| 179 | | HC DNA | synthetic | 1842 | nucleotide (coding strand) |
| 134 | G005-HC-L0-IFNα(A145D) IgG4 | LC aa | human | 214 | aa |
| 180 | | HC aa | synthetic | 614 | aa |
| 136 | | LC DNA | human | 642 | nucleotide (coding strand) |
| 181 | | HC DNA | synthetic | 1842 | nucleotide (coding strand) |
| 134 | G005-HC-L0-IFNα(A145E) IgG4 | LC aa | human | 214 | aa |
| 182 | | HC aa | synthetic | 614 | aa |
| 136 | | LC DNA | human | 642 | nucleotide (coding strand) |
| 183 | | HC DNA | synthetic | 1842 | nucleotide (coding strand) |
| 134 | G005-HC-L0-IFNα(A145G) IgG4 | LC aa | human | 214 | aa |
| 184 | | HC aa | synthetic | 614 | aa |
| 136 | | LC DNA | human | 642 | nucleotide (coding strand) |
| 185 | | HC DNA | synthetic | 1842 | nucleotide (coding strand) |
| 134 | G005-HC-L0-IFNα(A145H) IgG4 | LC aa | human | 214 | aa |
| 186 | | HC aa | synthetic | 614 | aa |
| 136 | | LC DNA | human | 642 | nucleotide (coding strand) |

TABLE 38-continued

SEQ ID NOs related to proteins comprising 2 polypeptide chains

| SEQ ID NO: | Protein Name | Chain | Species | Length | Unit |
|---|---|---|---|---|---|
| 187 | | HC DNA | synthetic | 1842 | nucleotide (coding strand) |
| 134 | G005-HC-L0-IFNα(A145I) IgG4 | LC aa | human | 214 | aa |
| 188 | | HC aa | synthetic | 614 | aa |
| 136 | | LC DNA | human | 642 | nucleotide (coding strand) |
| 189 | | HC DNA | synthetic | 1842 | nucleotide (coding strand) |
| 134 | G005-HC-L0-IFNα(A145K) IgG4 | LC aa | human | 214 | aa |
| 190 | | HC aa | synthetic | 614 | aa |
| 136 | | LC DNA | human | 642 | nucleotide (coding strand) |
| 191 | | HC DNA | synthetic | 1842 | nucleotide (coding strand) |
| 134 | G005-HC-L0-IFNα(A145L) IgG4 | LC aa | human | 214 | aa |
| 192 | | HC aa | synthetic | 614 | aa |
| 136 | | LC DNA | human | 642 | nucleotide (coding strand) |
| 193 | | HC DNA | synthetic | 1842 | nucleotide (coding strand) |
| 134 | G005-HC-L0-IFNα(A145N) IgG4 | LC aa | human | 214 | aa |
| 194 | | HC aa | synthetic | 614 | aa |
| 136 | | LC DNA | human | 642 | nucleotide (coding strand) |
| 195 | | HC DNA | synthetic | 1842 | nucleotide (coding strand) |
| 134 | G005-HC-L0-IFNα(A145Q) IgG4 | LC aa | human | 214 | aa |
| 196 | | HC aa | synthetic | 614 | aa |
| 136 | | LC DNA | human | 642 | nucleotide (coding strand) |
| 197 | | HC DNA | synthetic | 1842 | nucleotide (coding strand) |
| 134 | G005-HC-L0-IFNα(A145R) IgG4 | LC aa | human | 214 | aa |
| 198 | | HC aa | synthetic | 614 | aa |
| 136 | | LC DNA | human | 642 | nucleotide (coding strand) |
| 199 | | HC DNA | synthetic | 1842 | nucleotide (coding strand) |
| 134 | G005-HC-L0-IFNα(A145S) IgG4 | LC aa | human | 214 | aa |
| 200 | | HC aa | synthetic | 614 | aa |
| 136 | | LC DNA | human | 642 | nucleotide (coding strand) |
| 201 | | HC DNA | synthetic | 1842 | nucleotide (coding strand) |
| 134 | G005-HC-L0-IFNα(A145T) IgG4 | LC aa | human | 214 | aa |
| 202 | | HC aa | synthetic | 614 | aa |
| 136 | | LC DNA | human | 642 | nucleotide (coding strand) |
| 203 | | HC DNA | synthetic | 1842 | nucleotide (coding strand) |
| 134 | G005-HC-L0-IFNα(A145V) IgG4 | LC aa | human | 214 | aa |
| 204 | | HC aa | synthetic | 614 | aa |
| 136 | | LC DNA | human | 642 | nucleotide (coding strand) |
| 205 | | HC DNA | synthetic | 1842 | nucleotide (coding strand) |
| 134 | G005-HC-L0-IFNα(A145Y) IgG4 | LC aa | human | 214 | aa |
| 206 | | HC aa | synthetic | 614 | aa |
| 136 | | LC DNA | human | 642 | nucleotide (coding strand) |
| 207 | | HC DNA | synthetic | 1842 | nucleotide (coding strand) |
| 208 | G005-LC-L6-IFNα(A145G) IgG1 | LC aa | synthetic | 385 | aa |
| 135 | | HC aa | human | 452 | aa |
| 209 | | LC DNA | synthetic | 1155 | nucleotide (coding strand) |
| 137 | | HC DNA | human | 1356 | nucleotide (coding strand) |
| 210 | G005-LC-L0-IFNα(A145G) IgG1 | LC aa | synthetic | 379 | aa |
| 135 | | HC aa | human | 452 | aa |
| 211 | | LC DNA | synthetic | 1137 | nucleotide (coding strand) |
| 137 | | HC DNA | human | 1356 | nucleotide (coding strand) |
| 134 | G005-HC-L0-IFNβ IgG4 | LC aa | human | 214 | aa |

TABLE 38-continued

SEQ ID NOs related to proteins comprising 2 polypeptide chains

| SEQ ID NO: | Protein Name | Chain | Species | Length | Unit |
|---|---|---|---|---|---|
| 212 | | HC aa | synthetic | 615 | aa |
| 136 | | LC DNA | human | 642 | nucleotide (coding strand) |
| 213 | | HC DNA | synthetic | 1845 | nucleotide (coding strand) |
| 134 | G005-HC-L0-IFNβ(R35A) IgG4 | LC aa | human | 214 | aa |
| 214 | | HC aa | synthetic | 615 | aa |
| 136 | | LC DNA | human | 642 | nucleotide (coding strand) |
| 215 | | HC DNA | synthetic | 1845 | nucleotide (coding strand) |
| 134 | G005-HC-L0-IFNβ(R147A) IgG4 | LC aa | human | 214 | aa |
| 216 | | HC aa | synthetic | 615 | aa |
| 136 | | LC DNA | human | 642 | nucleotide (coding strand) |
| 217 | | HC DNA | synthetic | 1845 | nucleotide (coding strand) |
| 218 | MORAB03080 IgG1 | LC aa | human | 212 | aa |
| 219 | | HC aa | human | 452 | aa |
| 220 | | LC DNA | human | 636 | nucleotide (coding strand) |
| 221 | | HC DNA | human | 1356 | nucleotide (coding strand) |
| 222 | hu38SB19 (SAR650984) IgG1 | LC aa | synthetic | 214 | aa |
| 223 | | HC aa | synthetic | 450 | aa |
| 224 | | LC DNA | synthetic | 642 | nucleotide (coding strand) |
| 225 | | HC DNA | synthetic | 1350 | nucleotide (coding strand) |
| 226 | X355/02 IgG1 | LC aa | human | 222 | aa |
| 227 | | HC aa | human | 451 | aa |
| 228 | | LC DNA | human | 666 | nucleotide (coding strand) |
| 229 | | HC DNA | human | 1353 | nucleotide (coding strand) |
| 226 | X355/02-HC-L0-IFNα(R144A) IgG4 | LC aa | human | 222 | aa |
| 230 | | HC aa | synthetic | 613 | aa |
| 228 | | LC DNA | human | 666 | nucleotide (coding strand) |
| 231 | | HC DNA | synthetic | 1839 | nucleotide (coding strand) |
| 226 | X355/02-HC-L0-IFNα(A145D) IgG4 | LC aa | human | 222 | aa |
| 232 | | HC aa | synthetic | 613 | aa |
| 228 | | LC DNA | human | 666 | nucleotide (coding strand) |
| 233 | | HC DNA | synthetic | 1839 | nucleotide (coding strand) |
| 234 | X355/07 IgG | LC aa | human | 215 | aa |
| 235 | | HC aa | human | 448 | aa |
| 236 | | LC DNA | human | 645 | nucleotide (coding strand) |
| 237 | | HC DNA | human | 1344 | nucleotide (coding strand) |
| 234 | X355/07-HC-L0-IFNα(R144A) IgG4 | LC aa | human | 215 | aa |
| 238 | | HC aa | synthetic | 610 | aa |
| 236 | | LC DNA | human | 645 | nucleotide (coding strand) |
| 239 | | HC DNA | synthetic | 1830 | nucleotide (coding strand) |
| 234 | X355/07-HC-L0-IFNα(A145D) IgG4 | LC aa | human | 215 | aa |
| 240 | | HC aa | synthetic | 610 | aa |
| 236 | | LC DNA | human | 645 | nucleotide (coding strand) |
| 241 | | HC DNA | synthetic | 1830 | nucleotide (coding strand) |
| 242 | X910/12 IgG1 | LC aa | human | 222 | aa |
| 243 | | HC aa | human | 452 | aa |
| 244 | | LC DNA | human | 666 | nucleotide (coding strand) |
| 245 | | HC DNA | human | 1356 | nucleotide (coding strand) |
| 242 | X910/12-HC-L0-IFNα(R144A) IgG4 | LC aa | human | 222 | aa |
| 246 | | HC aa | synthetic | 614 | aa |
| 244 | | LC DNA | human | 666 | nucleotide (coding strand) |

TABLE 38-continued

SEQ ID NOs related to proteins comprising 2 polypeptide chains

| SEQ ID NO: | Protein Name | Chain | Species | Length | Unit |
|---|---|---|---|---|---|
| 247 | | HC DNA | synthetic | 1842 | nucleotide (coding strand) |
| 242 | X910/12-HC-L0-IFNα(A145D) IgG4 | LC aa | human | 222 | aa |
| 248 | | HC aa | synthetic | 614 | aa |
| 244 | | LC DNA | human | 666 | nucleotide (coding strand) |
| 249 | | HC DNA | synthetic | 1842 | nucleotide (coding strand) |
| 250 | X913/15 IgG1 | LC aa | human | 222 | aa |
| 251 | | HC aa | human | 450 | aa |
| 252 | | LC DNA | human | 666 | nucleotide (coding strand) |
| 253 | | HC DNA | human | 1350 | nucleotide (coding strand) |
| 250 | X913/15-HC-L0-IFNα(R144A) IgG4 | LC aa | human | 222 | aa |
| 254 | | HC aa | synthetic | 612 | aa |
| 252 | | LC DNA | human | 666 | nucleotide (coding strand) |
| 255 | | HC DNA | synthetic | 1836 | nucleotide (coding strand) |
| 250 | X913/15-HC-L0-IFNα(A145D) IgG4 | LC aa | human | 222 | aa |
| 256 | | HC aa | synthetic | 612 | aa |
| 252 | | LC DNA | human | 666 | nucleotide (coding strand) |
| 257 | | HC DNA | synthetic | 1836 | nucleotide (coding strand) |
| 258 | R5D1 IgG1 | LC aa | synthetic | 214 | aa |
| 259 | | HC aa | synthetic | 450 | aa |
| 260 | | LC DNA | synthetic | 642 | nucleotide (coding strand) |
| 261 | | HC DNA | synthetic | 1350 | nucleotide (coding strand) |
| 258 | R5D1-HC-L0-IFNα(A145D) IgG4 | LC aa | synthetic | 214 | aa |
| 262 | | HC aa | synthetic | 612 | aa |
| 260 | | LC DNA | synthetic | 642 | nucleotide (coding strand) |
| 263 | | HC DNA | synthetic | 1836 | nucleotide (coding strand) |
| 264 | R5E8 IgG1 | LC aa | synthetic | 219 | aa |
| 265 | | HC aa | synthetic | 453 | aa |
| 266 | | LC DNA | synthetic | 657 | nucleotide (coding strand) |
| 267 | | HC DNA | synthetic | 1359 | nucleotide (coding strand) |
| 264 | R5E8-HC-L0-IFNα(A145D) IgG4 | LC aa | synthetic | 219 | aa |
| 268 | | HC aa | synthetic | 615 | aa |
| 266 | | LC DNA | synthetic | 657 | nucleotide (coding strand) |
| 269 | | HC DNA | synthetic | 1845 | nucleotide (coding strand) |
| 270 | R10A2 IgG1 | LC aa | synthetic | 214 | aa |
| 271 | | HC aa | synthetic | 450 | aa |
| 272 | | LC DNA | synthetic | 642 | nucleotide (coding strand) |
| 273 | | HC DNA | synthetic | 1350 | nucleotide (coding strand) |
| 270 | R10A2-HC-L0-IFNα(A145D) IgG4 | LC aa | synthetic | 214 | aa |
| 274 | | HC aa | synthetic | 612 | aa |
| 272 | | LC DNA | synthetic | 642 | nucleotide (coding strand) |
| 275 | | HC DNA | synthetic | 1836 | nucleotide (coding strand) |
| 276 | Rituximab | LC aa | synthetic | 213 | aa |
| 277 | | HC aa | synthetic | 451 | aa |
| 278 | | LC DNA | synthetic | 639 | nucleotide (coding strand) |
| 279 | | HC DNA | synthetic | 1353 | nucleotide (coding strand) |
| 276 | Rituximab-HC-L6-IFNα IgG1 | LC aa | synthetic | 213 | aa |
| 280 | | HC aa | synthetic | 622 | aa |
| 278 | | LC DNA | synthetic | 639 | nucleotide (coding strand) |
| 281 | | HC DNA | synthetic | 1866 | nucleotide (coding strand) |
| 276 | Rituximab-HC-L6-IFNα(R144A) | LC aa | synthetic | 213 | aa |

TABLE 38-continued

SEQ ID NOs related to proteins comprising 2 polypeptide chains

| SEQ ID NO: | Protein Name | Chain | Species | Length | Unit |
|---|---|---|---|---|---|
| 282 | IgG1 | HC aa | synthetic | 622 | aa |
| 278 |  | LC DNA | synthetic | 639 | nucleotide (coding strand) |
| 283 |  | HC DNA | synthetic | 1866 | nucleotide (coding strand) |
| 276 | Rituximab-HC-L6-IFNα(A145G) | LC aa | synthetic | 213 | aa |
| 284 | IgG1 | HC aa | synthetic | 622 | aa |
| 278 |  | LC DNA | synthetic | 639 | nucleotide (coding strand) |
| 285 |  | HC DNA | synthetic | 1866 | nucleotide (coding strand) |
| 276 | Rituximab-HC-L6-IFNα(R33A + YNS) | LC aa | synthetic | 213 | aa |
| 286 | IgG1 | HC aa | synthetic | 622 | aa |
| 278 |  | LC DNA | synthetic | 639 | nucleotide (coding strand) |
| 287 |  | HC DNA | synthetic | 1866 | nucleotide (coding strand) |
| 276 | Rituximab-HC-L6- | LC aa | synthetic | 213 | aa |
| 288 | IFNα(R144A + YNS) IgG1 | HC aa | synthetic | 622 | aa |
| 278 |  | LC DNA | synthetic | 639 | nucleotide (coding strand) |
| 289 |  | HC DNA | synthetic | 1866 | nucleotide (coding strand) |
| 290 | Palivizumab | LC aa | synthetic | 213 | aa |
| 291 |  | HC aa | synthetic | 450 | aa |
| 292 |  | LC DNA | synthetic | 639 | nucleotide (coding strand) |
| 293 |  | HC DNA | synthetic | 1350 | nucleotide (coding strand) |
| 290 | Palivizumab-HC-L6-IFNα IgG1 | LC aa | synthetic | 213 | aa |
| 294 |  | HC aa | synthetic | 621 | aa |
| 292 |  | LC DNA | synthetic | 639 | nucleotide (coding strand) |
| 295 |  | HC DNA | synthetic | 1863 | nucleotide (coding strand) |
| 290 | Palivizumab-HC-L6-IFNα Fab | LC aa | synthetic | 213 | aa |
| 296 |  | HC aa | synthetic | 394 | aa |
| 292 |  | LC DNA | synthetic | 639 | nucleotide (coding strand) |
| 297 |  | HC DNA | synthetic | 1182 | nucleotide (coding strand) |
| 290 | Palivizumab-HC-L6-IFNα(A145D) | LC aa | synthetic | 213 | aa |
| 298 | Fab | HC aa | synthetic | 394 | aa |
| 292 |  | LC DNA | synthetic | 639 | nucleotide (coding strand) |
| 299 |  | HC DNA | synthetic | 1182 | nucleotide (coding strand) |
| 300 | J110 IgG1 | LC aa | synthetic | 214 | aa |
| 301 |  | HC aa | synthetic | 449 | aa |
| 302 |  | LC DNA | synthetic | 642 | nucleotide (coding strand) |
| 303 |  | HC DNA | synthetic | 1347 | nucleotide (coding strand) |
| 300 | J110-HC-L6-IL-4 IgG1 | LC aa | synthetic | 214 | aa |
| 304 |  | HC aa | synthetic | 584 | aa |
| 302 |  | LC DNA | synthetic | 642 | nucleotide (coding strand) |
| 305 |  | HC DNA | synthetic | 1752 | nucleotide (coding strand) |
| 300 | J110-HC-L6-IL-4(R88Q) IgG1 | LC aa | synthetic | 214 | aa |
| 306 |  | HC aa | synthetic | 584 | aa |
| 302 |  | LC DNA | synthetic | 642 | nucleotide (coding strand) |
| 307 |  | HC DNA | synthetic | 1752 | nucleotide (coding strand) |
| 300 | J110-HC-L16-IL-6 IgG1 | LC aa | synthetic | 214 | aa |
| 308 |  | HC aa | synthetic | 649 | aa |
| 302 |  | LC DNA | synthetic | 642 | nucleotide (coding strand) |
| 309 |  | HC DNA | synthetic | 1947 | nucleotide (coding strand) |
| 300 | J110-HC-L16-IL-6(R179E) IgG1 | LC aa | synthetic | 214 | aa |
| 310 |  | HC aa | synthetic | 649 | aa |
| 302 |  | LC DNA | synthetic | 642 | nucleotide (coding strand) |

TABLE 38-continued

SEQ ID NOs related to proteins comprising 2 polypeptide chains

| SEQ ID NO: | Protein Name | Chain | Species | Length | Unit |
|---|---|---|---|---|---|
| 311 | | HC DNA | synthetic | 1947 | nucleotide (coding strand) |
| 312 | HB95 IgG1 | LC aa | synthetic | 215 | aa |
| 313 | | HC aa | synthetic | 450 | aa |
| 314 | | LC DNA | synthetic | 645 | nucleotide (coding strand) |
| 315 | | HC DNA | synthetic | 1350 | nucleotide (coding strand) |
| 312 | HB95-HC-L0-IFNα(A145D) IgG4 | LC aa | synthetic | 215 | aa |
| 316 | | HC aa | synthetic | 612 | aa |
| 314 | | LC DNA | synthetic | 645 | nucleotide (coding strand) |
| 317 | | HC DNA | synthetic | 1836 | nucleotide (coding strand) |
| 312 | HB95-HC-L6-IFNα Fab | LC aa | synthetic | 215 | aa |
| 318 | | HC aa | synthetic | 394 | aa |
| 314 | | LC DNA | synthetic | 645 | nucleotide (coding strand) |
| 319 | | HC DNA | synthetic | 1182 | nucleotide (coding strand) |
| 312 | HB95-HC-L6-IFNα(A145D) Fab | LC aa | synthetic | 215 | aa |
| 320 | | HC aa | synthetic | 394 | aa |
| 314 | | LC DNA | synthetic | 645 | nucleotide (coding strand) |
| 321 | | HC DNA | synthetic | 1182 | nucleotide (coding strand) |
| 312 | HB95-HC-L16-IL-6 IgG1 | LC aa | synthetic | 215 | aa |
| 322 | | HC aa | synthetic | 650 | aa |
| 314 | | LC DNA | synthetic | 645 | nucleotide (coding strand) |
| 323 | | HC DNA | synthetic | 1950 | nucleotide (coding strand) |
| 312 | HB95-HC-L16-IL-6(R179E) IgG1 | LC aa | synthetic | 215 | aa |
| 324 | | HC aa | synthetic | 650 | aa |
| 314 | | LC DNA | synthetic | 645 | nucleotide (coding strand) |
| 325 | | HC DNA | synthetic | 1950 | nucleotide (coding strand) |
| 326 | nBT062 IgG1 | LC aa | synthetic | 214 | aa |
| 327 | | HC aa | synthetic | 452 | aa |
| 328 | | LC DNA | synthetic | 642 | nucleotide (coding strand) |
| 329 | | HC DNA | synthetic | 1356 | nucleotide (coding strand) |
| 326 | nBT062-HC-L0-IFNα(A145D) IgG4 | LC aa | synthetic | 214 | aa |
| 330 | | HC aa | synthetic | 614 | aa |
| 328 | | LC DNA | synthetic | 642 | nucleotide (coding strand) |
| 331 | | HC DNA | synthetic | 1842 | nucleotide (coding strand) |
| 332 | C21 IgG1 | LC aa | synthetic | 214 | aa |
| 333 | | HC aa | synthetic | 448 | aa |
| 334 | | LC DNA | synthetic | 642 | nucleotide (coding strand) |
| 335 | | HC DNA | synthetic | 1344 | nucleotide (coding strand) |
| 332 | C21-HC-L0-IFNα(A145D) IgG4 | LC aa | synthetic | 214 | aa |
| 336 | | HC aa | synthetic | 610 | aa |
| 334 | | LC DNA | synthetic | 642 | nucleotide (coding strand) |
| 337 | | HC DNA | synthetic | 1830 | nucleotide (coding strand) |
| 338 | 7.1 IgG1 | LC aa | synthetic | 214 | aa |
| 339 | | HC aa | synthetic | 449 | aa |
| 340 | | LC DNA | synthetic | 642 | nucleotide (coding strand) |
| 341 | | HC DNA | synthetic | 1347 | nucleotide (coding strand) |
| 338 | 7.1-HC-L0-IFNα(A145D) IgG4 | LC aa | synthetic | 214 | aa |
| 342 | | HC aa | synthetic | 611 | aa |
| 340 | | LC DNA | synthetic | 642 | nucleotide (coding strand) |
| 343 | | HC DNA | synthetic | 1833 | nucleotide (coding strand) |
| 344 | 2D12 IgG1 | LC aa | synthetic | 213 | aa |

TABLE 38-continued

SEQ ID NOs related to proteins comprising 2 polypeptide chains

| SEQ ID NO: | Protein Name | Chain | Species | Length | Unit |
|---|---|---|---|---|---|
| 345 | | HC aa | synthetic | 452 | aa |
| 346 | | LC DNA | synthetic | 639 | nucleotide (coding strand) |
| 347 | | HC DNA | synthetic | 1356 | nucleotide (coding strand) |
| 344 | 2D12-HC-L6-IFNα(A145G) IgG1 | LC aa | synthetic | 213 | aa |
| 348 | | HC aa | synthetic | 623 | aa |
| 346 | | LC DNA | synthetic | 639 | nucleotide (coding strand) |
| 349 | | HC DNA | synthetic | 1869 | nucleotide (coding strand) |
| 344 | 2D12-HC-L6-IFNα(A145G) IgG4 | LC aa | synthetic | 213 | aa |
| 350 | | HC aa | synthetic | 620 | aa |
| 346 | | LC DNA | synthetic | 639 | nucleotide (coding strand) |
| 351 | | HC DNA | synthetic | 1860 | nucleotide (coding strand) |
| 344 | 2D12-HC-L0-IFNα(A145D) IgG4 | LC aa | synthetic | 213 | aa |
| 352 | | HC aa | synthetic | 614 | aa |
| 346 | | LC DNA | synthetic | 639 | nucleotide (coding strand) |
| 353 | | HC DNA | synthetic | 1842 | nucleotide (coding strand) |
| 344 | 2D12-HC-L6-IFNα Fab | LC aa | synthetic | 213 | aa |
| 354 | | HC aa | synthetic | 396 | aa |
| 346 | | LC DNA | synthetic | 639 | nucleotide (coding strand) |
| 355 | | HC DNA | synthetic | 1188 | nucleotide (coding strand) |
| 344 | 2D12-HC-L6-IFNα(A145D) Fab | LC aa | synthetic | 213 | aa |
| 356 | | HC aa | synthetic | 396 | aa |
| 346 | | LC DNA | synthetic | 639 | nucleotide (coding strand) |
| 357 | | HC DNA | synthetic | 1188 | nucleotide (coding strand) |
| 344 | 2D12-HC-L6-IL-4(R88Q) IgG1 | LC aa | synthetic | 213 | aa |
| 358 | | HC aa | synthetic | 587 | aa |
| 346 | | LC DNA | synthetic | 639 | nucleotide (coding strand) |
| 359 | | HC DNA | synthetic | 1761 | nucleotide (coding strand) |
| 344 | 2D12-HC-L16-IL-6 IgG1 | LC aa | synthetic | 213 | aa |
| 360 | | HC aa | synthetic | 652 | aa |
| 346 | | LC DNA | synthetic | 639 | nucleotide (coding strand) |
| 361 | | HC DNA | synthetic | 1956 | nucleotide (coding strand) |
| 344 | 2D12-HC-L16-IL-6(R179E) IgG1 | LC aa | synthetic | 213 | aa |
| 362 | | HC aa | synthetic | 652 | aa |
| 346 | | LC DNA | synthetic | 639 | nucleotide (coding strand) |
| 363 | | HC DNA | synthetic | 1956 | nucleotide (coding strand) |
| 364 | X355/01 IgG1 | LC aa | human | 214 | aa |
| 365 | | HC aa | human | 455 | aa |
| 366 | | LC DNA | human | 642 | nucleotide (coding strand) |
| 367 | | HC DNA | human | 1365 | nucleotide (coding strand) |
| 368 | X355/04 IgG1 | LC aa | human | 219 | aa |
| 369 | | HC aa | human | 453 | aa |
| 370 | | LC DNA | human | 657 | nucleotide (coding strand) |
| 371 | | HC DNA | human | 1359 | nucleotide (coding strand) |
| 372 | R10B10 IgG1 | LC aa | synthetic | 220 | aa |
| 373 | | HC aa | synthetic | 449 | aa |
| 374 | R7H11 IgG1 | LC aa | synthetic | 220 | aa |
| 375 | | HC aa | synthetic | 449 | aa |
| 376 | R7F11 IgG1 | LC aa | synthetic | 214 | aa |
| 377 | | HC aa | synthetic | 452 | aa |

TABLE 38-continued

SEQ ID NOs related to proteins comprising 2 polypeptide chains

| SEQ ID NO: | Protein Name | Chain | Species | Length | Unit |
|---|---|---|---|---|---|
| 276 | Rituximab-HC-L7-IFNγ(Δ[A23, D24]) | LC aa | synthetic | 213 | aa |
| 378 | IgG1 | HC aa | synthetic | 599 | aa |
| 278 | | LC DNA | synthetic | 639 | nucleotide (coding strand) |
| 379 | | HC DNA | synthetic | 1797 | nucleotide (coding strand) |
| 226 | X355/02-HC-L7-IFNγ(S20I) IgG1 | LC aa | human | 222 | aa |
| 380 | | HC aa | synthetic | 601 | aa |
| 228 | | LC DNA | human | 666 | nucleotide (coding strand) |
| 381 | | HC DNA | synthetic | 1803 | nucleotide (coding strand) |
| 270 | R10A2-HC-L7-IFNγ(D21K) IgG1 | LC aa | synthetic | 214 | aa |
| 382 | | HC aa | synthetic | 600 | aa |
| 272 | | LC DNA | synthetic | 642 | nucleotide (coding strand) |
| 383 | | HC DNA | synthetic | 1800 | nucleotide (coding strand) |
| 276 | Rituximab-HC-L6-IFNα(R33A) IgG1 | LC aa | synthetic | 213 | aa |
| 436 | | HC aa | synthetic | 622 | aa |
| 278 | | LC DNA | synthetic | 639 | nucleotide (coding strand) |
| 437 | | HC DNA | synthetic | 1866 | nucleotide (coding strand) |

TABLE 39

Variable Domains

| SEQ ID NO: | Clone | Antigen | Chain | Species | Length (aa) |
|---|---|---|---|---|---|
| 384 | G005 | CD38 | Vκ | human | 107 |
| 385 | G005 | CD38 | VH | human | 122 |
| 386 | MORAB03080 | CD38 | Vλ | human | 106 |
| 387 | MORAB03080 | CD38 | VH | human | 122 |
| 388 | hu38SB19 (SAR650984) | CD38 | Vκ | synthetic | 107 |
| 389 | hu38SB19 (SAR650984) | CD38 | VH | synthetic | 120 |
| 390 | X355/02 | CD38 | Vλ | human | 116 |
| 391 | X355/02 | CD38 | VH | human | 121 |
| 392 | X355/07 | CD38 | Vκ | human | 108 |
| 393 | X355/07 | CD38 | VH | human | 118 |
| 394 | X910/12 | CD38 | Vλ | human | 116 |
| 395 | X910/12 | CD38 | VH | human | 122 |
| 396 | X913/15 | CD38 | Vλ | human | 116 |
| 397 | X913/15 | CD38 | VH | human | 120 |
| 398 | R5D1 | CD38 | Vκ | rat | 107 |
| 399 | R5D1 | CD38 | VH | rat | 120 |
| 400 | R5E8 | CD38 | Vκ | rat | 112 |
| 401 | R5E8 | CD38 | VH | rat | 123 |
| 402 | R10A2 | CD38 | Vκ | rat | 107 |
| 403 | R10A2 | CD38 | VH | rat | 120 |
| 404 | Rituximab | CD20 | Vκ | mouse | 106 |
| 405 | Rituximab | CD20 | VH | mouse | 121 |
| 406 | Palivizumab | Respiratory Syncytial Virus (RSV) | Vκ | synthetic | 106 |
| 407 | Palivizumab | RSV | VH | synthetic | 120 |
| 408 | J110 | PD-1 | Vκ | mouse | 107 |
| 409 | J110 | PD-1 | VH | mouse | 119 |
| 410 | HB95 | HLA | Vκ | mouse | 108 |
| 411 | HB95 | HLA | VH | mouse | 120 |
| 412 | nBT062 | CD138 | Vκ | mouse | 107 |
| 413 | nBT062 | CD138 | VH | mouse | 122 |
| 414 | C21 | High Molecular Weight Melanoma-Associated Antigen (HMW-MAA) | Vλ | synthetic | 108 |
| 415 | C21 | HMW-MAA | VH | synthetic | 118 |
| 416 | 7.1 | HMW-MAA | Vκ | mouse | 107 |
| 417 | 7.1 | HMW-MAA | VH | mouse | 119 |
| 418 | 2D12 | Yellow Fever Virus (YFV) | Vκ | mouse | 106 |
| 419 | 2D12 | YFV | VH | mouse | 122 |
| 420 | X355/01 | CD38 | Vκ | human | 107 |
| 421 | X355/01 | CD38 | VH | human | 125 |
| 422 | X355/04 | CD38 | Vκ | human | 112 |
| 423 | X355/04 | CD38 | VH | human | 123 |
| 424 | R10B10 | CD38 | Vλ | rat | 114 |
| 425 | R10B10 | CD38 | VH | rat | 119 |
| 426 | R7H11 | CD38 | Vλ | rat | 114 |
| 427 | R7H11 | CD38 | VH | rat | 119 |
| 428 | R7F11 | CD38 | Vκ | rat | 107 |
| 429 | R7F11 | CD38 | VH | rat | 122 |

TABLE 40

Other Single Polypeptide Chain Sequences

| SEQ ID NO: | Species | Length | Gene |
|---|---|---|---|
| 430 | human | 297 | CD20 |
| 431 | human | 288 | PD-1 |
| 432 | human | 310 | CD138 |
| 433 | human | 2322 | High Molecular Weight Melanoma-Associated Antigen (HMW-MAA) |
| 434 | human | 165 | IFNα2c |
| 435 | human | 166 | IFNα4a |

SEQUENCE LISTING (437 sequences)

SEQ ID NO: 1 - protein, 166 aa, homo sapiens
CDLPETHSLDNRRTLMLLAQMSRISPSSCLMDRHDFGFPQEEFDGNQFQKAPAISVLHELIQQIFNLFTTKDSSAAWDEDLLDKFCTELYQQLNDLEACVMQEERVGETPLMNVDSILAVKKYFRRITLYLTEKKYSPCAWEVVRAEIMRSLSLSTNLQERLRRKE

SEQ ID NO: 2 - protein, 165 aa, homo sapiens
CDLPQTHSLGSRRTLMLLAQMRKISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 3 - protein, 165 aa, homo sapiens [sequence omitted]

SEQ ID NO: 4 - protein, 165 aa, homo sapiens
CDLPQTHSLGSRRTAMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 5 - protein, 165 aa, homo sapiens
CDLPQTHSLGSRRTLMLLWQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 6 - protein, 165 aa, homo sapiens
CDLPQTHSLGSRRTLMLLAQMARISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 7 - protein, 165 aa, homo sapiens
CDLPQTHSLGSRRTLMLLAQMRAISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 8 - protein, 165 aa, homo sapiens
CDLPQTHSLGSRRTLMLLAQMRRIALFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 9 - protein, 165 aa, homo sapiens
CDLPQTHSLGSRRTLMLLAQMRRISAFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 10 - protein, 165 aa, homo sapiens
CDLPQTHSLGSRRTLMLLAQMRRISLASCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 11 - protein, 165 aa, homo sapiens
CDLPQTHSLGSRRTLMLLAQMRRISLFSCAKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 12 - protein, 165 aa, homo sapiens
CDLPQTHSLGSRRTLMLLAQMRRISLFSCVKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 13 - protein, 165 aa, homo sapiens
CDLPQTHSLGSRRTLMLLAQMRRISLFSCLADRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 14 - protein, 165 aa, homo sapiens
CDLPQTHSLGSRRTLMLLAQMRRISLFSCLKARHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 15 - protein, 165 aa, homo sapiens
CDLPQTHSLGSRRTLMLLAQMRRISLFSCLKDKHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 16 - protein, 165 aa, homo sapiens
CDLPQTHSLGSRRTLMLLAQMRRISLFSCLKDAHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 17 - protein, 165 aa, homo sapiens
CDLPQTHSLGSRRTLMLLAQMRRISLFSCLKDQHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 18 - protein, 165 aa, homo sapiens
CDLPQTHSLGSRRTLMLLAQMRRISLFSCLKDRADFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 19 - protein, 165 aa, homo sapiens
CDLPQTHSLGSRRTLMLLAQMRRISLFSCLKDRHDFGFPAEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 20 - protein, 165 aa, homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKERSILAVRKYFQRITLYLKEKKYSPCAWEVVRAEIMRSFSLSTNLQESLRSKE

SEQ ID NO: 21 - protein, 165 aa, homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSIAAVRKYFQRITLYLKEKKYSPCAWEVVRAEIMRSFSLSTNLQESLRSKE

SEQ ID NO: 22 - protein, 165 aa, homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVAKYFQRITLYLKEKKYSPCAWEVVRAEIMRSFSLSTNLQESLRSKE

SEQ ID NO: 23 - protein, 165 aa, homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVEKYFQRITLYLKEKKYSPCAWEVVRAEIMRSFSLSTNLQESLRSKE

SEQ ID NO: 24 - protein, 165 aa, homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQAITLYLKEKKYSPCAWEVVRAEIMRSFSLSTNLQESLRSKE

SEQ ID NO: 25 - protein, 165 aa, homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQEITLYLKEKKYSPCAWEVVRAEIMRSFSLSTNLQESLRSKE

SEQ ID NO: 26 - protein, 165 aa, homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLAEKKYSPCAWEVVRAEIMRSFSLSTNLQESLRSKE

SEQ ID NO: 27 - protein, 165 aa, homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKAKKYSPCAWEVVRAEIMRSFSLSTNLQESLRSKE

SEQ ID NO: 28 - protein, 165 aa, homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEAKYSPCAWEVVRAEIMRSFSLSTNLQESLRSKE

SEQ ID NO: 29 - protein, 165 aa, homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKAYSPCAWEVVRAEIMRSFSLSTNLQESLRSKE

SEQ ID NO: 30 - protein, 165 aa, homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVAAEIMRSFSLSTNLQESLRSKE

SEQ ID NO: 31 - protein, 165 aa, homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVDAEIMRSFSLSTNLQESLRSKE

SEQ ID NO: 32 - protein, 165 aa, homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVEAEIMRSFSLSTNLQESLRSKE

SEQ ID NO: 33 - protein, 165 aa, homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVGAEIMRSFSLSTNLQESLRSKE

SEQ ID NO: 34 - protein, 165 aa, homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVHAEIMRSFSLSTNLQESLRSKE

SEQ ID NO: 35 - protein, 165 aa, homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVIAEIMRSFSLSTNLQESLRSKE

SEQ ID NO: 36 - protein, 165 aa, homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVKAEIMRSFSLSTNLQESLRSKE

SEQ ID NO: 37 - protein, 165 aa, homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVLAEIMRSFSLSTNLQESLRSKE

SEQ ID NO: 38 - protein, 165 aa, homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVNAEIMRSFSLSTNLQESLRSKE

SEQ ID NO: 39 - protein, 165 aa, homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVQAEIMRSFSLSTNLQESLRSKE

SEQ ID NO: 40 - protein, 165 aa, homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVSAEIMRSFSLSTNLQESLRSKE

SEQ ID NO: 41 - protein, 165 aa, homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVTAEIMRSFSLSTNLQESLRSKE

SEQ ID NO: 42 - protein, 165 aa, homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVVAEIMRSFSLSTNLQESLRSKE

SEQ ID NO: 43 - protein, 165 aa, homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVYAEIMRSFSLSTNLQESLRSKE

SEQ ID NO: 44 - protein, 165 aa, homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRDEIMRSFSLSTNLQESLRSKE

SEQ ID NO: 45 - protein, 165 aa, homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVREEIMRSFSLSTNLQESLRSKE

SEQ ID NO: 46 - protein, 165 aa, homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRGEIMRSFSLSTNLQESLRSKE

SEQ ID NO: 47 - protein, 165 aa, homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRHEIMRSFSLSTNLQESLRSKE

SEQ ID NO: 48 - protein, 165 aa, homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRIEIMRSFSLSTNLQESLRSKE

SEQ ID NO: 49 - protein, 165 aa, homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRKEIMRSFSLSTNLQESLRSKE

SEQ ID NO: 50 - protein, 165 aa, homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRLEIMRSFSLSTNLQESLRSKE

SEQ ID NO: 51 - protein, 165 aa, homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRMEIMRSFSLSTNLQESLRSKE

SEQ ID NO: 52 - protein, 165 aa, homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRNEIMRSFSLSTNLQESLRSKE

SEQ ID NO: 53 - protein, 165 aa, homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRQEIMRSFSLSTNLQESLRSKE

SEQ ID NO: 54 - protein, 165 aa, homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRREIMRSFSLSTNLQESLRSKE

SEQ ID NO: 55 - protein, 165 aa, homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRSEIMRSFSLSTNLQESLRSKE

SEQ ID NO: 56 - protein, 165 aa, homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRTEIMRSFSLSTNLQESLRSKE

SEQ ID NO: 57 - protein, 165 aa, homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRVEIMRSFSLSTNLQESLRSKE

SEQ ID NO: 58 - protein, 165 aa, homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRYEIMRSFSLSTNLQESLRSKE

SEQ ID NO: 59 - protein, 165 aa, homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIARSFSLSTNLQESLRSKE

SEQ ID NO: 60 - protein, 165 aa, homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMASFSLSTNLQESLRSKE

SEQ ID NO: 61 - protein, 165 aa, homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFALSTNLQESLRSKE

SEQ ID NO: 62 - protein, 165 aa, homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSASTNLQESLRSKE

SEQ ID NO: 63 - protein, 165 aa, homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTALQESLRSKE

SEQ ID NO: 64 - protein, 165 aa, homo sapiens
CDLPQTHSLGSRRTLMLLAQMRRISLFSCAKDRHDFGFPQEEFGNQFQKAETIPVLYNMISQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 65 - protein, 165 aa, homo sapiens
CDLPQTHSLGSRRTLMLLAQMRRISLFSCLKDAHDFGFPQEEFGNQFQKAETIPVLYNMISQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 66 - protein, 165 aa, homo sapiens
CDLPQTHSLGSRRTLMLLAQMRRISLFSCLKDRHDFGFPQEEFGNQFQKAETIPVLYNMISQIFNLFSTKDSSAAWDETLLDKFYTELYQQLNDLEACVIQGVGVTETPLMKEDSILAVRKYFQRITLYLKEKKYSPCAWEVVRAEIARSFSLSTNLQESLRSKE

SEQ ID NO: 67 - protein, 165 aa, homo sapiens
CDLPQTHSLGSRRTLMLLAQMRRISLFSCLKDRHDFGFPQEEFGNQFQKAETIPVLYNMISQIFNLFSTKDSSAAWDETLLDKFYTELYQQLNDLEACVIQGVGVTETPLMKEDSILAVRKYFQRITLYLKEKKYSPCAWEVVRAEIMRSFSASTNLQESLRSKE

SEQ ID NO: 68 - protein, 165 aa, homo sapiens
CDLPQTHSLGSRRTLMLLAQMRRISLFSCLKDRHDFGFPQEEFGNQFQKAETIPVLYNMISQIFNLFSTKDSSAAWDETLLDKFYTELYQQLNDLEACVIQGVGVTETPLMKEDSILAVRKYFQRITLYLKEKKYSPCAWEVVAAEIMRSFSLSTNLQESLRSKE

SEQ ID NO: 69 - protein, 165 aa, homo sapiens
CDLPQTHSLGSRRTLMLLAQMRRISLFSCLKDRHDFGFPQEEFGNQFQKAETIPVLHEMIQQIFALFSTKDSSAAWDETALDKFATELAQQLNDLEACVIQGVGVTETPLMKEDSILAVRKYFQRITLYLKEKKYSPCAWEVVRAEIMRSFSLSTNLQESLRSKE

SEQ ID NO: 70 - protein, 165 aa, homo sapiens
CDLPQTHSLGSRRTLMLLAQMRRISLFSCLKDRHDFGFPQEEFGNQFQKAETIPVLHEMIQQIFALFSTKDSSAAWDETALDKFATELAQQLNDLEACVIQGVGVTETPLMKEASILAVRKYFQRITLYLKEKKYSPCAWEVVRAEIMRSFSLSTNLQESLRSKE

SEQ ID NO: 71 - protein, 165 aa, homo sapiens
CDLPQTHSLGSRRTLMLLAQMRRISLFSCLKDRHDFGFPQEEFGNQFQKAETIPVLHEMIQQIFALFSTKDSSAAWDETALDKFATELAQQLNDLEACVIQGVGVTETPLMKEDSIAAVRKYFQRITLYLKEKKYSPCAWEVVRAEIMRSFSLSTNLQESLRSKE

SEQ ID NO: 72 - protein, 165 aa, homo sapiens
CDLPQTHSLGSRRTLMLLAQMRRISLFSCLKDRHDFGFPQEEFGNQFQKAETIPVLHEMIQQIFALFSTKDSSAAWDETALDKFATELAQQLNDLEACVIQGVGVTETPLMKEDSILAVAKYFQRITLYLKEKKYSPCAWEVVRAEIMRSFSLSTNLQESLRSKE

SEQ ID NO: 73 - protein, 165 aa, homo sapiens
CDLPQTHSLGSRRTLMLLAQMRRISLFSCLKDRHDFGFPQEEFGNQFQKAETIPVLHEMIQQIFNLFSTKDSSAAWDETLLDKFATELAQQLNDLEACVIQGVGVTETPLMKEDSILAVAKYFQRITLYLKEKKYSPCAWEVVRAEIMRSFSLSTNLQESLRSKE

SEQ ID NO: 74 - protein, 165 aa, homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEASILAVAKYFQRITLYLKEKKYSPCAWEVVRAEIMRSFSLSTNLQESLRSKE

SEQ ID NO: 75 - protein, 165 aa, homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSIAAVAKYFQRITLYLKEKKYSPCAWEVVRAEIMRSFSLSTNLQESLRSKE

SEQ ID NO: 76 - protein, 165 aa, homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSIAAVAAYFQRITLYLKEKKYSPCAWEVVRAEIMRSFSLSTNLQESLRSKE

SEQ ID NO: 77 - protein, 165 aa, homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVAAYFQRITLYLKEKKYSPCAWEVVRAEIMRSFSLSTNLQESLRSKE

SEQ ID NO: 78 - protein, 165 aa, homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVEEYFQRITLYLKEKKYSPCAWEVVRAEIMRSFSLSTNLQESLRSKE

SEQ ID NO: 79 - protein, 160 aa, homo sapiens
CDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQES

SEQ ID NO: 80 - protein, 166 aa, homo sapiens
CDLPQTHSLGNRRALILLAQMGRISHFSCLKDRHDFGFPEEEFDGHQFQKTQAISVLHEMIQQTFNLFSTEDSSAAWEQSLLEKFSTELYQQLNDLEACVIQEVGVEETPLMNVDSILAVRKYFQRITLYLTEKKYSPCAWEVVRAEIMRSLSFSTNLQKRLRRKD

SEQ ID NO: 81 - protein, 166 aa, homo sapiens
CDLPQTHSLSNRRTLMIMAQMGRISPFSCLKDRHDFGFPQEEFDGNQFQKAQAISVLHEMIQQTFNLFSTKDSSATWDETLLDKFYTELYQQLNDLEACMMQEVGVEDTPLMNVDSILTVRKYFQRITLYLTEKKYSPCAWEVVRAEIMRSFSLSANLQERLRRKE

SEQ ID NO: 82 - protein, 166 aa, homo sapiens
CDLPQTHSLGHRRTMMLLAQMRRISLFSCLKDRHDFRFPQEEFDGNQFQKAEAISVLHEVIQQTFNLFSTKDSSVAWDERLLDKLYTELYQQLNDLEACVMQEVWVGGTPLMNEDSILAVRKYFQRITLYLTEKKYSPCAWEVVRAEIMRSFSSSRNLQERLRRKE

SEQ ID NO: 83 - protein, 166 aa, homo sapiens
CDLPQTHSLRNRRALILLAQMGRISPFSCLKDRHEFRFPEEEFDGHQFQKTQAISVLHEMIQQTFNLFSTEDSSAAWEQSLLEKFSTELYQQLNDLEACVIQEVGVEETPLMNEDFILAVRKYFQRITLYLMEKKYSPCAWEVVRAEIMRSFSFSTNLKKGLRRKD

SEQ ID NO: 84 - protein, 166 aa, homo sapiens
CDLPQTHSLGNRRALILLAQMRRISPFSCLKDRHDFEFPQEEFDDKQFQKAQAISVLHEMIQQTFNLFSTKDSSAALDETLLDEFYIELDQQLNDLESCVMQEVGVIESPLMYEDSILAVRKYFQRITLYLTEKKYSSCAWEVVRAEIMRSFSLSINLQKRLKSKE

SEQ ID NO: 85 - protein, 166 aa, homo sapiens
CDLPQTHSLGNRRALILLGQMGRISPFSCLKDRHDFRIPQEEFDGNQFQKAQAISVLHEMIQQTFNLFSTEDSSAAWEQSLLEKFSTELYQQLNDLEACVIQEVGVEETPLMNEDSILAVRKYFQRITLYLIERKYSPCAWEVVRAEIMRSLSFSTNLQKRLRRKD

SEQ ID NO: 86 - protein, 166 aa, homo sapiens
CDLPETHSLDNRRTLMLLAQMSRISPSSCLMDRHDFGFPQEEFDGNQFQKAPAISVLHELIQQIFNLFTTKDSSAAWDEDLLDKFCTELYQQLNDLEACVMQEERVGETPLMNADSILAVKKYFRRITLYLTEKKYSPCAWEVVRAEIMRSLSLSTNLQERLRRKE

SEQ ID NO: 87 - protein, 166 aa, homo sapiens
CNLSQTHSLNNRRTLMLMAQMRRISPFSCLKDRHDFEFPQEEFDGNQFQKAQAISVLHEMMQQTFNLFSTKNSSAAWDETLLEKFYIELFQQMNDLEACVIQEVGVEETPLMNEDSILAVKKYFQRITLYLMEKKYSPCAWEVVRAEIMRSLSFSTNLQKRLRRKD

SEQ ID NO: 88 - protein, 166 aa, homo sapiens
CDLPQTHSLGNRRALILLAQMGRISHFSCLKDRYDFGFPQEVFDGNQFQKAQAISAFHEMIQQTFNLFSTKDSSAAWDETLLDKFYIELFQQLNDLEACVTQEVGVEEIALMNEDSILAVRKYFQRITLYLMGKKYSPCAWEVVRAEIMRSFSFSTNLQKGLRRKD

SEQ ID NO: 89 - protein, 166 aa, homo sapiens
CDLPQTHSLGNRRALILLAQMGRISPFSCLKDRHDFGLPQEEFDGNQFQKTQAISVLHEMIQQTFNLFSTEDSSAAWEQSLLEKFSTELYQQLNNLEACVIQEVGMEETPLMNEDSILAVRKYFQRITLYLTEKKYSPCAWEVVRAEIMRSLSFSTNLQKILRRKD

SEQ ID NO: 90 - protein, 166 aa, homo sapiens
CDLPQTHSLGNRRALILLAQMGRISPFSCLKDRHDFGFPQEEFDGNQFQKAQAISVLHEMIQQTFNLFSTKDSSATWEQSLLEKFSTELNQQLNDLEACVIQEVGVEETPLMNVDSILAVKKYFQRITLYLTEKKYSPCAWEVVRAEIMRSFSLSKIFQERLRRKE

SEQ ID NO: 91 - protein, 166 aa, homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 92 - protein, 166 aa, homo sapiens
MSYNLLGFLQRSSNFQCQKLLWQLNGALEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 93 - protein, 166 aa, homo sapiens
MSYNLLGFLQRSSNFQCQKLLWQLNGRLEYCLKDTMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 94 - protein, 166 aa, homo sapiens
MSYNLLGFLQRSSNFQCQKLLWQLNGRLEYCLKDRMNFDIPKEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 95 - protein, 166 aa, homo sapiens
MSYNLLGFLQRSSNFQCQKLLWQLNGRLEYCLKDRMNFDIPEEIKQLQQFQKENAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 96 - protein, 166 aa, homo sapiens
MSYNLLGFLQRSSNFQCQKLLWQLNGRLEYCLKDRMNFDIPEEIKQLQQFQKEDAALTIYEILQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 97 - protein, 166 aa, homo sapiens
MSYNLLGFLQRSSNFQCQKLLWQLNGRLEYCLKDRMNFDIPEEIKQLQQFQKEDAALTIYEMLQNIFAIFRQDSSSTSWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 98 - protein, 166 aa, homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLARYYGRILHYLKAKEYSHCAWTIVRVEILRNFYFINRLTGYLRN

SEQ ID NO: 99 - protein, 166 aa, homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHYAWTIVRVEILRNFYFINRLTGYLRN

SEQ ID NO: 100 - protein, 166 aa, homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCTWTIVRVEILRNFYFINRLTGYLRN

SEQ ID NO: 101 - protein, 166 aa, homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVKILRNFYFINRLTGYLRN

SEQ ID NO: 102 - protein, 166 aa, homo sapiens
MSYNLLGFLQRSSNFQCQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILHNFYFINRLTGYLRN

SEQ ID NO: 103 - protein, 166 aa, homo sapiens
MSYNLLGFLQRSSNFQSQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 104 - protein, 166 aa, homo sapiens
MSYNLLGFLQRSSNFQSQKLLWQLNGRLEYCLKDAMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 105 - protein, 166 aa, homo sapiens
MSYNLLGFLQRSSNFQSQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVAVEILRNFYFINRLTGYLRN

SEQ ID NO: 106 - protein, 143 aa, homo sapiens
QDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRGRRASQ

SEQ ID NO: 107 - protein, 143 aa, homo sapiens
QDPYVKEAENLKKYFNAGHIDVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRGRRASQ

SEQ ID NO: 108 - protein, 143 aa, homo sapiens
QDPYVKEAENLKKYFNAGHCDVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRGRRASQ

SEQ ID NO: 109 - protein, 143 aa, homo sapiens
QDPYVKEAENLKKYFNAGHSKVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRGRRASQ

SEQ ID NO: 110 - protein, 143 aa, homo sapiens
QDPYVKEAENLKKYFNAGHSDDADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRGRRASQ

SEQ ID NO: 111 - protein, 143 aa, homo sapiens
QDPYVKEAENLKKYFNAGHSDVQDNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRGRRASQ

SEQ ID NO: 112 - protein, 143 aa, homo sapiens
QDPYVKEAENLKKYFNAGHSDVVDNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRGRRASQ

SEQ ID NO: 113 - protein, 143 aa, homo sapiens
QDPYVKEAENLKKYFNAGHSDVAANGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRGRRASQ

SEQ ID NO: 114 - protein, 141 aa, homo sapiens
QDPYVKEAENLKKYFNAGHSDVNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRGRRASQ

SEQ ID NO: 115 - protein, 141 aa, homo sapiens
QDPYVKEAENLKKYFNAGHSDVADTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRGRRASQ

SEQ ID NO: 116 - protein, 122 aa, homo sapiens
QDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSP

SEQ ID NO: 117 - protein, 129 aa, homo sapiens
QDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKR

SEQ ID NO: 118 - protein, 132 aa, homo sapiens
QDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRSQM

SEQ ID NO: 119 - protein, 129 aa, homo sapiens [sequence omitted]

SEQ ID NO: 120 - protein, 129 aa, homo sapiens
HKCDITLQKIIKTLNSLTEQKTLCTELTVTDIFAASKNTTEKETFCRAATVLRQFYSHHEKDTRCLGATAQQFHRHKQLIRFLKRLDRNLWGLAGLNSCPVKEANQSTLENFLERLKTIMREKYSKCSS

SEQ ID NO: 121 - protein, 129 aa, homo sapiens
HKCDITLQEIIKTLNSLTEQKTLCTELTVTDIFAASKNTTEKETFCRAATVLRQFYSHHEKDTRCLGATAQQFHRHKQLIRFLKRLDDNLWGLAGLNSCPVKEANQSTLENFLERLKTIMREKYSKCSS

SEQ ID NO: 122 - protein, 129 aa, homo sapiens
HKCDITLQEIIKTLNSLTEQKTLCTELTVTDIFAASKNTTEKETFCRAATVLRQFYSHHEKDTRCLGATAQQFHRHKQLIRFLKRLDQNLWGLAGLNSCPVKEANQSTLENFLERLKTIMREKYSKCSS

SEQ ID NO: 123 - protein, 184 aa, homo sapiens
PVPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 124 - protein, 184 aa, homo sapiens
PVPPGEDSKDVAAPHRQPLTSSERIDKQIRYILDGISALRKETCNKSNMCESSKEALAENNLNLPKMAEKDGCEQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 125 - protein, 184 aa, homo sapiens
PVPPGEDSKDVAAPHRQPLTSSERIDKQIRYILDGISALRKETCNKSNMCESSKEALAENNLNLPKMAEKDGCFQSGENEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 126 - protein, 184 aa, homo sapiens
PVPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLEALRQM

SEQ ID NO: 127 - protein, 310 aa, homo sapiens
MSALLILALVGAAVAGLNDIFEAQKIEWHEGSHHHHHHHHGSGSLVPRGSGSVPRWRQQWSGPGTTKRFPETVLARCVKYTEIHPEMRHVDCQSVWDAFKGAFISKHPCNITEEDYQPLMKLGTQTVPCNKILLWSRIKDLAHQFTQVQRDMFTLEDTLLGYLADDLTWCGEFNTSKINYQSCPDWRKDCSNNPVSVFWKTVSRRFAEAACDVVHVMLNGSRSKIFDKNSTFGSVEVHNLQPEKVQTLEAWVIHGGREDSRDLCQDPTIKELESIISKRNIQFSCKNIYRPDKFLQCVKNPEDSSCTSEI

SEQ ID NO: 128 - protein, 310 aa, cynomolgus
MSALLILALVGAAVAGLNDIFEAQKIEWHEGSHHHHHHHHGSGSLVPRGSGSLPRWRQQWSGSGTTSRFPETVLARCVKYTEVHPEMRHVDCQSVWDAFKGAFISKYPCNITEEDYQPLVKLGTQTVPCNKTLLWSRIKDLAHQFTQVQRDMFTLEDMLLGYLADDLTWCGEFNTFEINYQSCPDWRKDCSNNPVSVFWKTVSRRFAETACGVVHVMLNGSRSKIFDKNSTFGSVEVHNLQPEKVQALEAWVIHGGREDSRDLCQDPTIKELESIISKRNIRFFCKNIYRPDKFLQCVKNPEDSSCLSGI

SEQ ID NO: 129 - DNA, 774 bp, homo sapiens
gtgcctaggtggcggcagcagtggtccggccctggcaccaccaagaggttccccgagacagtgctggccagatgcgtgaagtacaccgagatccaccccgagatgaggcacgtggactgccagagcgtgtgggacgccttcaagggcgccttcatcagcaagcacccctgcaacatcaccgaagaggactaccagcccctgatgaagctgggcacccagaccgtgccctgcaacaagatcctgctgtggtccaggatcaaggacctggcccatcagttcacccaggtgcagagggacatgttcaccctggaagataccctgctgggctacctggccgacgacctgacttggtgcggcgagttcaacaccagcaagatcaactaccagagctgccccgactggcggaaggactgcagcaacaaccccgtgtccgtgttctggaaaaccgtgtccagaagattcgccgaggccgcctgcgacgtggtgcacgtgatgctgaacggcagcaggtccaagatcttcgacaagaacagcaccttcggcagcgtggaagtgcacaacctgcagcccgagaaggtgcagaccctggaagcctgggtgatccacggcggcagagaggacagcagggacctgtgccaggaccccaccatcaaagagctggaatccatcatctccaagcggaacatccagttcagctgcaagaacatctacaggcccgacaagttcctgcagtgcgtgaagaaccctgaggacagctcctgcaccagcgagatc

SEQ ID NO: 130 - protein, 258 aa, homo sapiens
VPRWRQQWSGPGTTKRFPETVLARCVKYTEIHPEMRHVDCQSVWDAFKGAFISKHPCNITEEDYQPLMKLGTQTVPCNKILLWSRIKDLAHQFTQVQRDMFTLEDTLLGYLADDLTWCGEFNTSKINYQSCPDWRKDCSNNPVSVFWKTVSRRFAEAACDVVHVMLNGSRSKIFDKNSTFGSVEVHNLQPEKVQTLEAWVIHGGREDSRDLCQDPTIKELESIISKRNIQFSCKNIYRPDKFLQCVKNPEDSSCTSEI

SEQ ID NO: 131 - protein, 300 aa, homo sapiens
MANCEFSPVSGDKPCCRLSRRAQLCLGVSILVLILVVVLAVVVPRWRQQWSGPGTTKRFPETVLARCVKYTEIHPEMRHVDCQSVWDAFKGAFISKHPCNITEEDYQPLMKLGTQTVPCNKILLWSRIKDLAHQFTQVQRDMFTLEDTLLGYLADDLTWCGEFNTSKINYQSCPDWRKDCSNNPVSVFWKTVSRRFAEAACDVVHVMLNGSRSKIFDKNSTFGSVEVHNLQPEKVQTLEAWVIHGGREDSRDLCQDPTIKELESIISKRNIQFSCKNIYRPDKFLQCVKNPEDSSCTSEI

SEQ ID NO: 132 - protein, 6 aa, Artificial Sequence
  Synthetic
SGGGGS

SEQ ID NO: 133 - protein, 16 aa, artificial
  Synthetic
SGGGGSGGGGSGGGGS

SEQ ID NO: 134 - protein, 214 aa, Homo sapiens
EIVLTQSPATLSLSPGERATLSCRASQSVSSYLAWYQQKPGQAPRLLIYDASNRATGIPARFSGSGSGTDFTLTISSLEPEDFAVYYCQQRSNWPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 135 - protein, 452 aa, homo sapiens
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 136 - DNA, 642 bp, homo sapiens
gaaattgtgttgacacagtctccagccaccctgtctttgtctccaggggaaagagccaccctctcctgcagggccagtcagagtgttagcagctacttggcctggtaccaacagaaacctggccaggctcccaggctcctcatctatgatgcctccaacagggccactggcatcccagccaggttcagtggcagtgggtctgggacagacttcactctcaccatcagcagcctggagcctgaagattttgcagtttattactgtcagcagcgtagcaactggcctccgacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagttcaccggtgacaaagagcttcaacaggggagagtgt

SEQ ID NO: 137 - DNA, 1356 bp, homo sapiens
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 138 - protein, 617 aa, artificial
  Synthetic
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVAAEIMRSFSLSTNLQESLRSKE

SEQ ID NO: 139 - DNA, 1851 bp, artificial
  Synthetic
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcgcagcagaaatcatgagatctttttctttgtcaacaaacttgcaagaaagtttaagaagtaaggaa

SEQ ID NO: 140 - protein, 623 aa, artificial
  Synthetic
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGGSCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVAAEIMRSFSLSTNLQESLRSKE

SEQ ID NO: 141 - DNA, 1869 bp, artificial
  Synthetic
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatccggaggcggcgggagctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcgcagcagaaatcatgagatctttttctttgtcaacaaacttgcaagaaagtttaagaagtaaggaa

SEQ ID NO: 142 - protein, 617 aa, artificial
  Synthetic
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRGEIMRSFSLSTNLQESLRSKE

SEQ ID NO: 143 - DNA, 1851 bp, artificial
  Synthetic
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagaggagaaatcatgagatctttttctttgtcaacaaacttgcaagaaagtttaagaagtaaggaa

SEQ ID NO: 144 - protein, 623 aa, artificial
  Synthetic
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGGSCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRGEIMRSFSLSTNLQESLRSKE

SEQ ID NO: 145 - DNA, 1869 bp, artificial
  Synthetic
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatccggaggcggcgggagctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagaggagaaatcatgagatctttttctttgtcaacaaacttgcaagaaagtttaagaagtaaggaa

SEQ ID NO: 146 - protein, 620 aa, artificial
  Synthetic
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKSGGGGSCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVAAEIMRSFSLSTNLQESLRSKE

SEQ ID NO: 147 - DNA, 1860 bp, artificial
  Synthetic
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatccggaggcggcgggagctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcgcagcagaaatcatgagatctttttctttgtcaacaaacttgcaagaaagtttaagaagtaaggaa

SEQ ID NO: 148 - protein, 620 aa, artificial
  Synthetic
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKSGGGGSCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRGEIMRSFSLSTNLQESLRSKE

SEQ ID NO: 149 - DNA, 1860 bp, artificial
  Synthetic
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatccggaggcggcgggagctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagaggagaaatcatgagatctttttctttgtcaacaaacttgcaagaaagtttaagaagtaaggaa

SEQ ID NO: 150 - protein, 614 aa, artificial
  Synthetic
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 151 - DNA, 1842 bp, artificial
  Synthetic
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaa

SEQ ID NO: 152 - protein, 614 aa, artificial
  Synthetic
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVAAEIMRSFSLSTNLQESLRSKE

SEQ ID NO: 153 - DNA, 1842 bp, artificial
  Synthetic
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcgcagcagaaatcatgagatctttttctttgtcaacaaacttgcaagaaagtttaagaagtaaggaa

SEQ ID NO: 154 - protein, 614 aa, artificial
  Synthetic
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVDAEIMRSFSLSTNLQESLRSKE

SEQ ID NO: 155 - DNA, 1842 bp, artificial
  Synthetic
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcgatgcagaaatcatgagatctttttctttgtcaacaaacttgcaagaaagtttaagaagtaaggaa

SEQ ID NO: 156 - protein, 614 aa, artificial
  Synthetic
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVEAEIMRSFSLSTNLQESLRSKE

SEQ ID NO: 157 - DNA, 1842 bp, artificial
  Synthetic
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcgaggcagaaatcatgagatctttttctttgtcaacaaacttgcaagaaagtttaagaagtaaggaa

SEQ ID NO: 158 - protein, 614 aa, artificial
  Synthetic
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVGAEIMRSFSLSTNLQESLRSKE

SEQ ID NO: 159 - DNA, 1842 bp, artificial
  Synthetic
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcggcgcagaaatcatgagatctttttctttgtcaacaaacttgcaagaaagtttaagaagtaaggaa

SEQ ID NO: 160 - protein, 614 aa, artificial
  Synthetic
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVHAEIMRSFSLSTNLQESLRSKE

SEQ ID NO: 161 - DNA, 1842 bp, artificial
  Synthetic
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtccacgcagaaatcatgagatctttttctttgtcaacaaacttgcaagaaagtttaagaagtaaggaa

SEQ ID NO: 162 - protein, 614 aa, artificial
  Synthetic
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVIAEIMRSFSLSTNLQESLRSKE

SEQ ID NO: 163 - DNA, 1842 bp, artificial
  Synthetic
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcatcgcagaaatcatgagatctttttctttgtcaacaaacttgcaagaaagtttaagaagtaaggaa

SEQ ID NO: 164 - protein, 614 aa, artificial
  Synthetic
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVKAEIMRSFSLSTNLQESLRSKE

SEQ ID NO: 165 - DNA, 1842 bp, artificial
  Synthetic
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcaaggcagaaatcatgagatctttttctttgtcaacaaacttgcaagaaagtttaagaagtaaggaa

SEQ ID NO: 166 - protein, 614 aa, artificial
  Synthetic
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVLAEIMRSFSLSTNLQESLRSKE

SEQ ID NO: 167 - DNA, 1842 bp, artificial
  Synthetic
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcctggcagaaatcatgagatctttttctttgtcaacaaacttgcaagaaagtttaagaagtaaggaa

SEQ ID NO: 168 - protein, 614 aa, artificial
  Synthetic
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVNAEIMRSFSLSTNLQESLRSKE

SEQ ID NO: 169 - DNA, 1842 bp, artificial
  Synthetic
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcaacgcagaaatcatgagatctttttctttgtcaacaaacttgcaagaaagtttaagaagtaaggaa

SEQ ID NO: 170 - protein, 614 aa, artificial
  Synthetic
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVQAEIMRSFSLSTNLQESLRSKE

SEQ ID NO: 171 - DNA, 1842 bp, artificial
  Synthetic
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtccaggcagaaatcatgagatctttttctttgtcaacaaacttgcaagaaagtttaagaagtaaggaa

SEQ ID NO: 172 - protein, 614 aa, artificial
  Synthetic
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVSAEIMRSFSLSTNLQESLRSKE

SEQ ID NO: 173 - DNA, 1842 bp, artificial
  Synthetic
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagcgcagaaatcatgagatctttttctttgtcaacaaacttgcaagaaagtttaagaagtaaggaa

SEQ ID NO: 174 - protein, 614 aa, artificial
  Synthetic
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVTAEIMRSFSLSTNLQESLRSKE

SEQ ID NO: 175 - DNA, 1842 bp, artificial
  Synthetic
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcaccgcagaaatcatgagatctttttctttgtcaacaaacttgcaagaaagtttaagaagtaaggaa

SEQ ID NO: 176 - protein, 614 aa, artificial
  Synthetic
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVVAEIMRSFSLSTNLQESLRSKE

SEQ ID NO: 177 - DNA, 1842 bp, artificial
  Synthetic
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcgtggcagaaatcatgagatctttttctttgtcaacaaacttgcaagaaagtttaagaagtaaggaa

SEQ ID NO: 178 - protein, 614 aa, artificial
  Synthetic
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVYAEIMRSFSLSTNLQESLRSKE

SEQ ID NO: 179 - DNA, 1842 bp, artificial
  Synthetic
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtctacgcagaaatcatgagatctttttctttgtcaacaaacttgcaagaaagtttaagaagtaaggaa

SEQ ID NO: 180 - protein, 614 aa, artificial
  Synthetic
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRDEIMRSFSLSTNLQESLRSKE

SEQ ID NO: 181 - DNA, 1842 bp, artificial
  Synthetic
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagatgaaatcatgagatctttttctttgtcaacaaacttgcaagaaagtttaagaagtaaggaa

SEQ ID NO: 182 - protein, 614 aa, artificial
  Synthetic
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVREEIMRSFSLSTNLQESLRSKE

SEQ ID NO: 183 - DNA, 1842 bp, artificial
  Synthetic
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagaggaaatcatgagatctttttctttgtcaacaaacttgcaagaaagtttaagaagtaaggaa

SEQ ID NO: 184 - protein, 614 aa, artificial
  Synthetic
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRGEIMRSFSLSTNLQESLRSKE

SEQ ID NO: 185 - DNA, 1842 bp, artificial
  Synthetic
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagaggagaaatcatgagatctttttctttgtcaacaaacttgcaagaaagtttaagaagtaaggaa

SEQ ID NO: 186 - protein, 614 aa, artificial
  Synthetic
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRHEIMRSFSLSTNLQESLRSKE

SEQ ID NO: 187 - DNA, 1842 bp, artificial
  Synthetic
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagacacgaaatcatgagatctttttctttgtcaacaaacttgcaagaaagtttaagaagtaaggaa

SEQ ID NO: 188 - protein, 614 aa, artificial
  Synthetic
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRIEIMRSFSLSTNLQESLRSKE

SEQ ID NO: 189 - DNA, 1842 bp, artificial
  Synthetic
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagaatcgaaatcatgagatctttttctttgtcaacaaacttgcaagaaagtttaagaagtaaggaa

SEQ ID NO: 190 - protein, 614 aa, artificial
  Synthetic
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRKEIMRSFSLSTNLQESLRSKE

SEQ ID NO: 191 - DNA, 1842 bp, artificial
  Synthetic
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagaaaggaaatcatgagatctttttctttgtcaacaaacttgcaagaaagtttaagaagtaaggaa

SEQ ID NO: 192 - protein, 614 aa, artificial
  Synthetic
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRLEIMRSFSLSTNLQESLRSKE

SEQ ID NO: 193 - DNA, 1842 bp, artificial
  Synthetic
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagactggaaatcatgagatctttttctttgtcaacaaacttgcaagaaagtttaagaagtaaggaa

SEQ ID NO: 194 - protein, 614 aa, artificial
  Synthetic
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRNEIMRSFSLSTNLQESLRSKE

SEQ ID NO: 195 - DNA, 1842 bp, artificial
  Synthetic
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagaaacgaaatcatgagatctttttctttgtcaacaaacttgcaagaaagtttaagaagtaaggaa

SEQ ID NO: 196 - protein, 614 aa, artificial
  Synthetic
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRQEIMRSFSLSTNLQESLRSKE

SEQ ID NO: 197 - DNA, 1842 bp, artificial
  Synthetic
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagacaggaaatcatgagatctttttctttgtcaacaaacttgcaagaaagtttaagaagtaaggaa

SEQ ID NO: 198 - protein, 614 aa, artificial
  Synthetic
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRREIMRSFSLSTNLQESLRSKE

SEQ ID NO: 199 - DNA, 1842 bp, artificial
  Synthetic
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagacgcgaaatcatgagatctttttctttgtcaacaaacttgcaagaaagtttaagaagtaaggaa

SEQ ID NO: 200 - protein, 614 aa, artificial
  Synthetic
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRSEIMRSFSLSTNLQESLRSKE

SEQ ID NO: 201 - DNA, 1842 bp, artificial
  Synthetic
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagaagcgaaatcatgagatctttttctttgtcaacaaacttgcaagaaagtttaagaagtaaggaa

SEQ ID NO: 202 - protein, 614 aa, artificial
  Synthetic
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRTEIMRSFSLSTNLQESLRSKE

SEQ ID NO: 203 - DNA, 1842 bp, artificial
  Synthetic
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagaaccgaaatcatgagatctttttctttgtcaacaaacttgcaagaaagtttaagaagtaaggaa

SEQ ID NO: 204 - protein, 614 aa, artificial
  Synthetic
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRVEIMRSFSLSTNLQESLRSKE

SEQ ID NO: 205 - DNA, 1842 bp, artificial
  Synthetic
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagtcgaaatcatgagatctttttctttgtcaacaaacttgcaagaaagtttaagaagtaaggaa

SEQ ID NO: 206 - protein, 614 aa, artificial
  Synthetic
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRYEIMRSFSLSTNLQESLRSKE

SEQ ID NO: 207 - DNA, 1842 bp, artificial
  Synthetic
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagatacgaaatcatgagatctttttctttgtcaacaaacttgcaagaaagtttaagaagtaaggaa

SEQ ID NO: 208 - protein, 385 aa, artificial
  Synthetic
EIVLTQSPATLSLSPGERATLSCRASQSVSSYLAWYQQKPGQAPRLLIYDASNRATGIPARFSGSGSGTDFTLTISSLEPEDFAVYYCQQRSNWPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECSGGGGSCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRGEIMRSFSLSTNLQESLRSKE

SEQ ID NO: 209 - DNA, 1155 bp, artificial
  Synthetic
gaaattgtgttgacacagtctccagccaccctgtctttgtctccaggggaaagagccaccctctcctgcagggccagtcagagtgttagcagctacttggcctggtaccaacagaaacctggccaggctcccaggctcctcatctatgatgcctccaacagggccactggcatcccagccaggttcagtggcagtgggtctgggacagacttcactctcaccatcagcagcctggagcctgaagattttgcagtttattactgtcagcagcgtagcaactggcctccgacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagttcaccggtgacaaagagcttcaacaggggagagtgttccggaggcggcgggagctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagaggagaaatcatgagatctttttctttgtcaacaaacttgcaagaaagtttaagaagtaaggaa

SEQ ID NO: 210 - protein, 379 aa, artificial
  Synthetic
EIVLTQSPATLSLSPGERATLSCRASQSVSSYLAWYQQKPGQAPRLLIYDASNRATGIPARFSGSGSGTDFTLTISSLEPEDFAVYYCQQRSNWPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRGEIMRSFSLSTNLQESLRSKE

SEQ ID NO: 211 - DNA, 1137 bp, artificial
  Synthetic
gaaattgtgttgacacagtctccagccaccctgtctttgtctccaggggaaagagccaccctctcctgcagggccagtcagagtgttagcagctacttggcctggtaccaacagaaacctggccaggctcccaggctcctcatctatgatgcctccaacagggccactggcatcccagccaggttcagtggcagtgggtctgggacagacttcactctcaccatcagcagcctggagcctgaagattttgcagtttattactgtcagcagcgtagcaactggcctccgacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagttcaccggtgacaaagagcttcaacaggggagagtgttgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagaggagaaatcatgagatctttttctttgtcaacaaacttgcaagaaagtttaagaagtaaggaa

SEQ ID NO: 212 - protein, 615 aa, artificial
  Synthetic
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMSYNLLGFLQRSSNFQSQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 213 - DNA, 1845 bp, artificial
  Synthetic
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaaatgagctacaacctgcttggattcctccaaagaagcagcaattttcagtcccagaagctcctgtggcaactgaatgggaggctcgaatattgcctcaaggacaggatgaactttgacatccctgaggagattaagcagctgcagcagttccagaaggaggacgccgcattgaccatctatgagatgctccagaacatctttgctattttcagacaagattcctctagcactggctggaatgagactattgttgagaacctcctggctaatgtctatcatcagataaaccatctgaagacagtcctggaagaaaaactggagaaagaagatttcaccaggggaaaactcatgagcagtctgcacctgaaaagatattatgggaggattctgcattacctgaaggccaaggagtacagtcactgtgcctggaccatagtcagagtggaaatcctgaggaacttttacttcattaacagacttacaggttacctccgaaac

SEQ ID NO: 214 - protein, 615 aa, artificial
  Synthetic
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMSYNLLGFLQRSSNFQSQKLLWQLNGRLEYCLKDAMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 215 - DNA, 1845 bp, artificial
  Synthetic
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaaatgagctacaacctgcttggattcctccaaagaagcagcaattttcagtcccagaagctcctgtggcaactgaatgggaggctcgaatattgcctcaaggacgcgatgaactttgacatccctgaggagattaagcagctgcagcagttccagaaggaggacgccgcattgaccatctatgagatgctccagaacatctttgctattttcagacaagattcctctagcactggctggaatgagactattgttgagaacctcctggctaatgtctatcatcagataaaccatctgaagacagtcctggaagaaaaactggagaaagaagatttcaccaggggaaaactcatgagcagtctgcacctgaaaagatattatgggaggattctgcattacctgaaggccaaggagtacagtcactgtgcctggaccatagtcagagtggaaatcctgaggaacttttacttcattaacagacttacaggttacctccgaaac

SEQ ID NO: 216 - protein, 615 aa, artificial
  Synthetic
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMSYNLLGFLQRSSNFQSQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVAVEILRNFYFINRLTGYLRN

SEQ ID NO: 217 - DNA, 1845 bp, artificial
  Synthetic
gaggtgcagctgttggagtctgggggaggcttggtacagcctggggggtccctgagactctcatgtgcagtctctggattcacctttaacagctttgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagcctgagagccgaggacacggccgtatatttctgtgcgaaagataagattctctggttcggggagcccgtctttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaaatgagctacaacctgcttggattcctccaaagaagcagcaattttcagtcccagaagctcctgtggcaactgaatgggaggctcgaatattgcctcaaggacaggatgaactttgacatccctgaggagattaagcagctgcagcagttccagaaggaggacgccgcattgaccatctatgagatgctccagaacatctttgctattttcagacaagattcctctagcactggctggaatgagactattgttgagaacctcctggctaatgtctatcatcagataaaccatctgaagacagtcctggaagaaaaactggagaaagaagatttcaccaggggaaaactcatgagcagtctgcacctgaaaagatattatgggaggattctgcattacctgaaggccaaggagtacagtcactgtgcctggaccatagtcgcagtggaaatcctgaggaacttttacttcattaacagacttacaggttacctccgaaac

SEQ ID NO: 218 - protein, 212 aa, homo sapiens
DIELTQPPSVSVAPGQTARISCSGDNIGNKYVSWYQQKPGQAPVVVIYGDNNRPSGIPERFSGSNSGNTATLTISGTQAEDEADYYCSSYDSSYFVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 219 - protein, 452 aa, homo sapiens
QVQLVESGGGLVQPGGSLRLSCAASGFTFSSYGMHWVRQAPGKGLEWVSNIYSDGSNTFYADSVKGRFTISRDNSKNTLYLQMNSLRAEDTAVYYCARNMYRWPFHYFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 220 - DNA, 636 bp, homo sapiens
gatatcgaactgacccagccgccttcagtgagcgttgcaccaggtcagaccgcgcgtatctcctgtagcggcgataatattggtaataagtatgtttcttggtaccagcagaaacccgggcaggcgccagttgttgtgatttatggtgataataatcgtccctcaggcatcccggaacgctttagcggctccaacagcggcaacaccgcgaccctgaccattagcggcactcaggcggaagacgaagcggattattattgctcttcttatgattcttcttattttgtgtttggcggcggcacgaagctgaccgtcctaggtcagcccaaggccgctcccagcgtgaccctgttccccccaagcagcgaggaactgcaggccaacaaggccaccctggtgtgcctgatcagcgacttctaccctggggccgtgaccgtggcctggaaggccgatagcagccctgtgaaggccggcgtggaaaccaccaccccctccaagcagagcaacaacaaatacgccgccagcagctacctgtccctgacccccgagcagtggaagtcccaccggtcctacagctgccaggtgacacacgagggcagcaccgtggaaaagaccgtggcccccaccgagtgcagc

SEQ ID NO: 221 - DNA, 1356 bp, homo sapiens
caggtgcaattggtggaaagcggcggcggcctggtgcaaccgggcggcagcctgcgcctgagctgcgcggcctccgggtttaccttttcttcttatggtatgcactgggtgcgccaagcccctgggaagggtctggagtgggtgagcaatatctattctgatggtagcaataccttttatgcggatagcgtgaaaggccggtttaccatttcaagagataattccaaaaacaccctgtatctgcaaatgaacagcctgagggcggaagatacggccgtgtattattgcgcgagaaatatgtatcgctggccttttcattatttttttgattattggggccaaggcaccctggtgacggttagctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 222 - protein, 214 aa, artificial
  Synthetic
DIVMTQSHLSMSTSLGDPVSITCKASQDVSTVVAWYQQKPGQSPRRLIYSASYRYIGVPDRFTGSGAGTDFTFTISSVQAEDLAVYYCQQHYSPPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 223 - protein, 450 aa, artificial
  Synthetic
QVQLVQSGAEVAKPGTSVKLSCKASGYTFTDYWMQWVKQRPGQGLEWIGTIYPGDGDTGYAQKFQGKATLTADKSSKTVYMHLSSLASEDSAVYYCARGDYYGSNSLDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 224 - DNA, 642 bp, artificial
  Synthetic
gatatcgtaatgacccagtcccacctgagtatgagtacctccctgggagatcctgtgtcaatcacttgcaaggcctcacaggatgtgagcaccgtcgttgcttggtatcagcagaagcccgggcaatcacccagacgtctcatctactcagcatcataccgttacatcggggtgcctgaccgatttactggctctggcgctggcacagatttcacctttacaattagttccgtccaggccgaagacctggccgtgtactactgccagcagcactacagtcccccatacactttcgggggagggactaagctcgaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagttcaccggtgacaaagagcttcaacaggggagagtgt

SEQ ID NO: 225 - DNA, 1350 bp, homo sapiens
caggtacagctcgttcagtccggcgccgaggtagctaagcctggtacttccgtaaaattgtcctgtaaggcttccgggtacacatttacagactactggatgcagtgggtaaaacagcggccaggtcagggcctggagtggattggaacaatatatcccggcgacggcgacacaggctatgcccagaagtttcaaggcaaggcaacccttactgctgataaatcttccaagactgtctacatgcacctgtcttccttggcatctgaggatagcgctgtctattactgtgctaggggggactactatgggtcaaattccctggattactggggccagggcaccagtgtcaccgtgagcagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 226 - protein, 222 aa, homo sapiens
QAVLTQPASLSASPGESARLTCTLPSDINVRYYNIYWYQQKPGSPPRYLLYYYSDSHKGQGSGVPSRFSGSKDVSTNSGILLISGLQSEDEADYYCMTWSSNGSGVFGGGTQLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 227 - protein, 451 aa, homo sapiens
QLQLQESGPGLVKPSETLSLTCTVSGGSISSSSYYWSWIRQHPGKGLEWIGYIYYSGSTNYNPSLKSRVTISVDTLKNQISLRLTSVTAADTAVYYCARVGGAGGWPMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 228 - DNA, 666 bp, homo sapiens
caggctgtgctgactcagccggcttccctctctgcatctcctggagaatccgccagactcacctgcaccttgcccagtgacatcaatgttcgttactacaacatatactggtaccagcagaagccagggagccctcccaggtatctcctgtactactactcagactcacataagggccagggctctggagtccccagccgcttctctggatccaaagatgtttcaaccaattcagggattttactcatctccgggctccagtctgaggatgaggctgactattactgtatgacttggtcaagcaatggttctggggtgttcggcggagggacccagctgaccgtcctaggtcagcccaaggccgctcccagcgtgaccctgttccccccaagcagcgaggaactgcaggccaacaaggccaccctggtgtgcctgatcagcgacttctaccctggggccgtgaccgtggcctggaaggccgatagcagccctgtgaaggccggcgtggaaaccaccaccccctccaagcagagcaacaacaaatacgccgccagcagctacctgtccctgacccccgagcagtggaagtcccaccggtcctacagctgccaggtgacacacgagggcagcaccgtggaaaagaccgtggcccccaccgagtgcagc

SEQ ID NO: 229 - DNA, 1353 bp, artificial
  Synthetic
cagctgcagctgcaggagtcgggcccaggactggtgaagccttcggagaccctgtccctcacctgcactgtctctggtggctccatcagcagtagtagttactactggagctggatccgccagcacccagggaagggcctggagtggattgggtacatctattacagtgggagcaccaactacaacccctccctcaagagtcgagtcaccatatcagttgacacgttgaagaaccagatctccctcagactgacttctgtgaccgctgcggacacggccgtgtattactgtgcgagagtcgggggagccggtggctggcccatggacgtctggggccaagggaccacggtcaccgtctcctcagctagcaccaagggacccagcgtgttccccctggcccccagcagcaagagcacatctggcggaacagccgccctgggctgcctggtgaaagactacttccccgagcccgtgaccgtgagctggaacagcggagccctgaccagcggcgtgcacacctttccagccgtgctgcagagcagcggcctgtacagcctgagcagcgtggtgacagtgccctctagcagcctgggcacccagacctacatctgcaacgtgaaccacaagcccagcaacaccaaggtggacaaaaaggtggaacccaagagctgcgacaagacccacacctgtcccccctgccctgcccctgaactgctgggcggaccctccgtgttcctgttccccccaaagcccaaggacaccctgatgatcagccggacccccgaagtgacctgcgtggtggtggacgtgtcccacgaggaccctgaagtgaagttcaattggtacgtggacggcgtggaagtgcacaacgccaagaccaagcccagagaggaacagtacaacagcacctaccgggtggtgtccgtgctgaccgtgctgcaccaggactggctgaacggcaaagagtacaagtgcaaggtgtccaacaaggccctgcctgctcccatcgagaaaaccatcagcaaggccaagggccagccccgcgagcctcaggtgtacacactgccccccagccgggacgagctgaccaagaaccaggtgtccctgacctgtctggtgaaaggcttctaccccagcgatatcgccgtggaatgggagagcaacggccagcccgagaacaactacaagaccaccccccctgtgctggacagcgacggctcattcttcctgtacagcaagctgaccgtggacaagagccggtggcagcagggcaacgtgttcagctgcagcgtgatgcacgaggccctgcacaaccactacacccagaagtccctgagcctgagccccggcaag

SEQ ID NO: 230 - protein, 613 aa, artificial
  Synthetic
QLQLQESGPGLVKPSETLSLTCTVSGGSISSSSYYWSWIRQHPGKGLEWIGYIYYSGSTNYNPSLKSRVTISVDTLKNQISLRLTSVTAADTAVYYCARVGGAGGWPMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVAAEIMRSFSLSTNLQESLRSKE

SEQ ID NO: 231 - DNA, 1839 bp, artificial
  Synthetic
cagctgcagctgcaggagtcgggcccaggactggtgaagccttcggagaccctgtccctcacctgcactgtctctggtggctccatcagcagtagtagttactactggagctggatccgccagcacccagggaagggcctggagtggattgggtacatctattacagtgggagcaccaactacaacccctccctcaagagtcgagtcaccatatcagttgacacgttgaagaaccagatctccctcagactgacttctgtgaccgctgcggacacggccgtgtattactgtgcgagagtcgggggagccggtggctggcccatggacgtctggggccaagggaccacggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcgcagcagaaatcatgagatctttttctttgtcaacaaacttgcaagaaagtttaagaagtaaggaa

SEQ ID NO: 232 - protein, 613 aa, artificial
  Synthetic
QLQLQESGPGLVKPSETLSLTCTVSGGSISSSSYYWSWIRQHPGKGLEWIGYIYYSGSTNYNPSLKSRVTISVDTLKNQISLRLTSVTAADTAVYYCARVGGAGGWPMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRDEIMRSFSLSTNLQESLRSKE

SEQ ID NO: 233 - DNA, 1839 bp, homo sapiens
cagctgcagctgcaggagtcgggcccaggactggtgaagccttcggagaccctgtccctcacctgcactgtctctggtggctccatcagcagtagtagttactactggagctggatccgccagcacccagggaagggcctggagtggattgggtacatctattacagtgggagcaccaactacaacccctccctcaagagtcgagtcaccatatcagttgacacgttgaagaaccagatctccctcagactgacttctgtgaccgctgcggacacggccgtgtattactgtgcgagagtcgggggagccggtggctggcccatggacgtctggggccaagggaccacggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagatgaaatcatgagatctttttctttgtcaacaaacttgcaagaaagtttaagaagtaaggaa

SEQ ID NO: 234 - protein, 215 aa, homo sapiens
AIQMTQSPSSLSASVGDRVTITCRASQSISSYLNWYQQKPGKAPKLLIYAASSLQSGVPSRFSGSGSGTDFTLTISSLQPEDFATYYCQQSYFTPLYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 235 - protein, 448 aa, homo sapiens
QVQLQESGPGLVKPSETLSLTCAVYGGSFSGYYWSWIRQPPGKGLEWIGSIYHSGSTYYNPSLKSRVTISVDTSKNQFSLKLSSVTAADTAVYYCARDLYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 236 - DNA, 645 bp, homo sapiens
gccatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaaccggaagattttgcaacttactactgtcaacagagttactttacccccctgtacacttttggccaggggaccaagctggagatcaaacgtacggtggcggcgcccagcgtgttcatcttcccacccagcgacgagcagctgaagtccggcacagccagcgtggtgtgcctgctgaacaacttctacccccgcgaggccaaggtgcagtggaaggtggacaacgccctgcagagcggcaacagccaggaaagcgtgaccgagcaggacagcaaggactccacctacagcctgagcagcaccctgaccctgagcaaggccgactacgagaagcacaaggtgtacgcctgcgaagtgacccaccagggcctgtccagccccgtgaccaagagcttcaaccggggcgagtgc

SEQ ID NO: 237 - DNA, 1344 bp, artificial
  Synthetic
caggtgcagctacaggagtcgggcccaggactggtgaagccttcggagaccctgtccctcacctgcgctgtctatggtgggtccttcagtggttactactggagctggatccgccagcccccagggaaggggctggagtggattgggagtatctatcatagtgggagcacctactacaacccgtccctcaagagtcgagtcaccatatcagtagacacgtccaagaaccagttctccctgaagctgagctctgtgaccgccgcagacacggccgtgtattactgtgcgagagatttgtactactactacggtatggacgtctggggccaagggaccacggtcaccgtctcctcagctagcaccaagggacccagcgtgttccccctggcccccagcagcaagagcacatctggcggaacagccgccctgggctgcctggtgaaagactacttccccgagcccgtgaccgtgagctggaacagcggagccctgaccagcggcgtgcacacctttccagccgtgctgcagagcagcggcctgtacagcctgagcagcgtggtgacagtgccctctagcagcctgggcacccagacctacatctgcaacgtgaaccacaagcccagcaacaccaaggtggacaaaaaggtggaacccaagagctgcgacaagacccacacctgtcccccctgccctgcccctgaactgctgggcggaccctccgtgttcctgttccccccaaagcccaaggacaccctgatgatcagccggacccccgaagtgacctgcgtggtggtggacgtgtcccacgaggaccctgaagtgaagttcaattggtacgtggacggcgtggaagtgcacaacgccaagaccaagcccagagaggaacagtacaacagcacctaccgggtggtgtccgtgctgaccgtgctgcaccaggactggctgaacggcaaagagtacaagtgcaaggtgtccaacaaggccctgcctgctcccatcgagaaaaccatcagcaaggccaagggccagccccgcgagcctcaggtgtacacactgccccccagccgggacgagctgaccaagaaccaggtgtccctgacctgtctggtgaaaggcttctaccccagcgatatcgccgtggaatgggagagcaacggccagcccgagaacaactacaagaccaccccccctgtgctggacagcgacggctcattcttcctgtacagcaagctgaccgtggacaagagccggtggcagcagggcaacgtgttcagctgcagcgtgatgcacgaggccctgcacaaccactacacccagaagtccctgagcctgagccccggcaag

SEQ ID NO: 238 - protein, 610 aa, artificial
  Synthetic
QVQLQESGPGLVKPSETLSLTCAVYGGSFSGYYWSWIRQPPGKGLEWIGSIYHSGSTYYNPSLKSRVTISVDTSKNQFSLKLSSVTAADTAVYYCARDLYYYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVAAEIMRSFSLSTNLQESLRSKE

SEQ ID NO: 239 - DNA, 1830 bp, artificial
  Synthetic
caggtgcagctacaggagtcgggcccaggactggtgaagccttcggagaccctgtccctcacctgcgctgtctatggtgggtccttcagtggttactactggagctggatccgccagcccccagggaaggggctggagtggattgggagtatctatcatagtgggagcacctactacaacccgtccctcaagagtcgagtcaccatatcagtagacacgtccaagaaccagttctccctgaagctgagctctgtgaccgccgcagacacggccgtgtattactgtgcgagagatttgtactactactacggtatggacgtctggggccaagggaccacggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcgcagcagaaatcatgagatctttttctttgtcaacaaacttgcaagaaagtttaagaagtaaggaa

SEQ ID NO: 240 - protein, 610 aa, artificial [sequence omitted]

SEQ ID NO: 241 - DNA, 1830 bp, homo sapiens
caggtgcagctacaggagtcgggcccaggactggtgaagccttcggagaccctgtccctcacctgcgctgtctatggtgggtccttcagtggttactactggagctggatccgccagcccccagggaaggggctggagtggattgggagtatctatcatagtgggagcacctactacaacccgtccctcaagagtcgagtcaccatatcagtagacacgtccaagaaccagttctccctgaagctgagctctgtgaccgccgcagacacggccgtgtattactgtgcgagagatttgtactactactacggtatggacgtctggggccaagggaccacggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagatgaaatcatgagatctttttctttgtcaacaaacttgcaagaaagtttaagaagtaaggaa

SEQ ID NO: 242 - protein, 222 aa, homo sapiens
QAVLTQPASLSASPGESARLTCTLPSDINVRYYNIYWYQQKPGSPPRYLLYYYSDSHKDQGSGVPSRFSGSKDTSANTGILLISGLQSEDEADYYCMIWASNGSGVLGGGTQLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 243 - protein, 452 aa, homo sapiens
EVQLVQSGAEVKKSGASVKVSCKASGYTFTDYYIHWVRQAPGQGLEWMGWINPNNGGVTFAQKFQGRVTMTRDTSISTAYMDLSSLRSDDTAVYFCARDIRMSGWLAPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 244 - DNA, 666 bp, homo sapiens
caggctgtgctgactcagccggcttccctctctgcatctcctggagaatccgccagactcacctgcaccttgcccagtgacatcaatgttcgttactacaacatatactggtatcagcagaagccagggagccctcccaggtatctcctatactactactcagactcacataaggaccagggctctggagtccccagccgcttctctggatccaaagatacttcagccaatacagggattttactcatctccgggctccagtctgaggatgaggctgactattactgtatgatttgggcaagcaatggttctggggtgctcggcggaggcacccagctgaccgtcctaggtcagcccaaggccgctcccagcgtgaccctgttccccccaagcagcgaggaactgcaggccaacaaggccaccctggtgtgcctgatcagcgacttctaccctggggccgtgaccgtggcctggaaggccgatagcagccctgtgaaggccggcgtggaaaccaccaccccctccaagcagagcaacaacaaatacgccgccagcagctacctgtccctgacccccgagcagtggaagtcccaccggtcctacagctgccaggtgacacacgagggcagcaccgtggaaaagaccgtggcccccaccgagtgcagc

SEQ ID NO: 245 - DNA, 1356 bp, artificial
  Synthetic
gaggtccagctggtacagtctggggctgaggtgaagaagtctggggcctcagtgaaggtctcctgcaaggcttctggatacaccttcaccgactactatatacactgggtgcgacaggcccctggacaagggcttgagtggatgggatggatcaaccctaacaatggtggcgtaacctttgcccagaagtttcagggcagggtcaccatgaccagggacacgtccatcagcacagcctacatggacctgagcagcctgagatctgacgacacggccgtctacttctgtgcgagagatattcgaatgagcgggtggctggcgccatttgactactggggccagggaaccctggtcaccgtctcctcagctagcaccaagggacccagcgtgttccccctggcccccagcagcaagagcacatctggcggaacagccgccctgggctgcctggtgaaagactacttccccgagcccgtgaccgtgagctggaacagcggagccctgaccagcggcgtgcacacctttccagccgtgctgcagagcagcggcctgtacagcctgagcagcgtggtgacagtgccctctagcagcctgggcacccagacctacatctgcaacgtgaaccacaagcccagcaacaccaaggtggacaaaaaggtggaacccaagagctgcgacaagacccacacctgtcccccctgccctgcccctgaactgctgggcggaccctccgtgttcctgttccccccaaagcccaaggacaccctgatgatcagccggacccccgaagtgacctgcgtggtggtggacgtgtcccacgaggaccctgaagtgaagttcaattggtacgtggacggcgtggaagtgcacaacgccaagaccaagcccagagaggaacagtacaacagcacctaccgggtggtgtccgtgctgaccgtgctgcaccaggactggctgaacggcaaagagtacaagtgcaaggtgtccaacaaggccctgcctgctcccatcgagaaaaccatcagcaaggccaagggccagccccgcgagcctcaggtgtacacactgccccccagccgggacgagctgaccaagaaccaggtgtccctgacctgtctggtgaaaggcttctaccccagcgatatcgccgtggaatgggagagcaacggccagcccgagaacaactacaagaccaccccccctgtgctggacagcgacggctcattcttcctgtacagcaagctgaccgtggacaagagccggtggcagcagggcaacgtgttcagctgcagcgtgatgcacgaggccctgcacaaccactacacccagaagtccctgagcctgagccccggcaag

SEQ ID NO: 246 - protein, 614 aa, artificial
  Synthetic
EVQLVQSGAEVKKSGASVKVSCKASGYTFTDYYIHWVRQAPGQGLEWMGWINPNNGGVTFAQKFQGRVTMTRDTSISTAYMDLSSLRSDDTAVYFCARDIRMSGWLAPFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVAAEIMRSFSLSTNLQESLRSKE

SEQ ID NO: 247 - DNA, 1842 bp, artificial
  Synthetic
gaggtccagctggtacagtctggggctgaggtgaagaagtctggggcctcagtgaaggtctcctgcaaggcttctggatacaccttcaccgactactatatacactgggtgcgacaggcccctggacaagggcttgagtggatgggatggatcaaccctaacaatggtggcgtaacctttgcccagaagtttcagggcagggtcaccatgaccagggacacgtccatcagcacagcctacatggacctgagcagcctgagatctgacgacacggccgtctacttctgtgcgagagatattcgaatgagcgggtggctggcgccatttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcgcagcagaaatcatgagatctttttctttgtcaacaaacttgcaagaaagtttaagaagtaaggaa

SEQ ID NO: 248 - protein, 614 aa, artificial
  Synthetic
EVQLVQSGAEVKKSGASVKVSCKASGYTFTDYYIHWVRQAPGQGLEWMGWINPNNGGVTFAQKFQGRVTMTRDTSISTAYMDLSSLRSDDTAVYFCARDIRMSGWLAPFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRDEIMRSFSLSTNLQESLRSKE

SEQ ID NO: 249 - DNA, 1842 bp, homo sapiens
gaggtccagctggtacagtctggggctgaggtgaagaagtctggggcctcagtgaaggtctcctgcaaggcttctggatacaccttcaccgactactatatacactgggtgcgacaggcccctggacaagggcttgagtggatgggatggatcaaccctaacaatggtggcgtaacctttgcccagaagtttcagggcagggtcaccatgaccagggacacgtccatcagcacagcctacatggacctgagcagcctgagatctgacgacacggccgtctacttctgtgcgagagatattcgaatgagcgggtggctggcgccatttgactactggggccagggaaccctggtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagatgaaatcatgagatctttttctttgtcaacaaacttgcaagaaagtttaagaagtaaggaa

SEQ ID NO: 250 - protein, 222 aa, homo sapiens
QAVLTQPASLSASPGESARLTCTLPSDINVRYHNIYWYQEKPGSPPRYLLYYYSDSSKGQGSGVPSRFSGSKDVSTNTGILVISGLQSEDEAEYYCMTWSSNGSGVFGGGTQLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 251 - protein, 450 aa, homo sapiens
QVQLVESGGGVVQGGGSLRLSCAASGFTVRSNYMSWVRQAPGKGLEWVSAISGSGDSTYYADSVKGRFTISRDNSKNTLYLQMNSLRAEDTAVYYCAKVAVTTGWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 252 - DNA, 666 bp, homo sapiens
caggctgtgctgactcagccggcttccctctctgcatctcctggagaatccgccagactcacctgcaccttgcccagtgacatcaatgttcgttaccacaacatatactggtatcaggagaagccagggagtccacccaggtatctcctgtactactactcagactcaagtaagggccagggctctggagtccccagccgcttctctggatccaaagatgtttcaaccaatacagggattttagtcatctccgggctccagtctgaggatgaggctgagtattactgtatgacttggtcaagcaatggttctggggtgttcggcggaggcacccagctgaccgtcctaggtcagcccaaggccgctcccagcgtgaccctgttccccccaagcagcgaggaactgcaggccaacaaggccaccctggtgtgcctgatcagcgacttctaccctggggccgtgaccgtggcctggaaggccgatagcagccctgtgaaggccggcgtggaaaccaccaccccctccaagcagagcaacaacaaatacgccgccagcagctacctgtccctgacccccgagcagtggaagtcccaccggtcctacagctgccaggtgacacacgagggcagcaccgtggaaaagaccgtggcccccaccgagtgcagc

SEQ ID NO: 253 - DNA, 1350 bp, artificial
  Synthetic
caggtgcagctggtggagtctgggggaggcgtggtccaggggggggggtccctgagactctcctgtgcagcctctggattcaccgtcagaagcaactacatgagctgggtccgccaggctccagggaaggggctggagtgggtctcagctattagtggtagtggtgatagcacatactatgcagactccgtgaagggccggttcaccatctccagagacaactccaagaatacgttgtatttgcaaatgaacagcctgagagccgaggacacggccgtatattactgtgcgaaagtagcggtgactacaggctggtacttcgatctctggggccgtggcaccctggtcactgtctcctcagctagcaccaagggacccagcgtgttccccctggcccccagcagcaagagcacatctggcggaacagccgccctgggctgcctggtgaaagactacttccccgagcccgtgaccgtgagctggaacagcggagccctgaccagcggcgtgcacacctttccagccgtgctgcagagcagcggcctgtacagcctgagcagcgtggtgacagtgccctctagcagcctgggcacccagacctacatctgcaacgtgaaccacaagcccagcaacaccaaggtggacaaaaaggtggaacccaagagctgcgacaagacccacacctgtcccccctgccctgcccctgaactgctgggcggaccctccgtgttcctgttccccccaaagcccaaggacaccctgatgatcagccggacccccgaagtgacctgcgtggtggtggacgtgtcccacgaggaccctgaagtgaagttcaattggtacgtggacggcgtggaagtgcacaacgccaagaccaagcccagagaggaacagtacaacagcacctaccgggtggtgtccgtgctgaccgtgctgcaccaggactggctgaacggcaaagagtacaagtgcaaggtgtccaacaaggccctgcctgctcccatcgagaaaaccatcagcaaggccaagggccagccccgcgagcctcaggtgtacacactgccccccagccgggacgagctgaccaagaaccaggtgtccctgacctgtctggtgaaaggcttctaccccagcgatatcgccgtggaatgggagagcaacggccagcccgagaacaactacaagaccaccccccctgtgctggacagcgacggctcattcttcctgtacagcaagctgaccgtggacaagagccggtggcagcagggcaacgtgttcagctgcagcgtgatgcacgaggccctgcacaaccactacacccagaagtccctgagcctgagccccggcaag

SEQ ID NO: 254 - protein, 612 aa, artificial
  Synthetic
QVQLVESGGGVVQGGGSLRLSCAASGFTVRSNYMSWVRQAPGKGLEWVSAISGSGDSTYYADSVKGRFTISRDNSKNTLYLQMNSLRAEDTAVYYCAKVAVTTGWYFDLWGRGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVAAEIMRSFSLSTNLQESLRSKE

SEQ ID NO: 255 - DNA, 1836 bp, artificial
  Synthetic
caggtgcagctggtggagtctgggggaggcgtggtccaggggggggggtccctgagactctcctgtgcagcctctggattcaccgtcagaagcaactacatgagctgggtccgccaggctccagggaaggggctggagtgggtctcagctattagtggtagtggtgatagcacatactatgcagactccgtgaagggccggttcaccatctccagagacaactccaagaatacgttgtatttgcaaatgaacagcctgagagccgaggacacggccgtatattactgtgcgaaagtagcggtgactacaggctggtacttcgatctctggggccgtggcaccctggtcactgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcgcagcagaaatcatgagatctttttctttgtcaacaaacttgcaagaaagtttaagaagtaaggaa

SEQ ID NO: 256 - protein, 612 aa, artificial
  Synthetic
QVQLVESGGGVVQGGGSLRLSCAASGFTVRSNYMSWVRQAPGKGLEWVSAISGSGDSTYYADSVKGRFTISRDNSKNTLYLQMNSLRAEDTAVYYCAKVAVTTGWYFDLWGRGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRDEIMRSFSLSTNLQESLRSKE

SEQ ID NO: 257 - DNA, 1836 bp, artificial
  Synthetic
caggtgcagctggtggagtctgggggaggcgtggtccaggggggggggtccctgagactctcctgtgcagcctctggattcaccgtcagaagcaactacatgagctgggtccgccaggctccagggaaggggctggagtgggtctcagctattagtggtagtggtgatagcacatactatgcagactccgtgaagggccggttcaccatctccagagacaactccaagaatacgttgtatttgcaaatgaacagcctgagagccgaggacacggccgtatattactgtgcgaaagtagcggtgactacaggctggtacttcgatctctggggccgtggcaccctggtcactgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagatgaaatcatgagatctttttctttgtcaacaaacttgcaagaaagtttaagaagtaaggaa

SEQ ID NO: 258 - protein, 214 aa, artificial
  Synthetic
DIQMTQSPASLSASLGETVTIECRASEDIYSNLAWYQQKPGNSPQLLIYDANSLADGVPSRFSASGSGTQFSLKINSLRSEDVASYFCQQYNNYPYTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 259 - protein, 450 aa, artificial
  Synthetic
EVQLQQSGPEVGRPGSSVKISCKASGYTFTDYIMHWVKQSPGQGLEWIGWIDPEYGRTDYAEKFKKKATLTADTSSSTAYIQLSSLASEDTATYFCARSAHTTGFGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 260 - DNA, 642 bp, artificial
  Synthetic
gacatccagatgacacagtctccagcttccctgtctgcatctctgggagaaactgtcaccatcgaatgtcgagcaagtgaggacatttacagtaatttagcgtggtatcagcagaaaccagggaactctcctcagctcctgatctatgatgcaaatagcttggcagatggggtcccatcacggttcagtgccagtggatctggcacacagttttctctaaagataaacagcctgcgatctgaagatgtcgcaagttatttctgtcaacagtataacaattatccgtacacgtttggagctgggaccaagctggaactgaagcgtacggtggcggcgcccagcgtgttcatcttcccacccagcgacgagcagctgaagtccggcacagccagcgtggtgtgcctgctgaacaacttctacccccgcgaggccaaggtgcagtggaaggtggacaacgccctgcagagcggcaacagccaggaaagcgtgaccgagcaggacagcaaggactccacctacagcctgagcagcaccctgaccctgagcaaggccgactacgagaagcacaaggtgtacgcctgcgaagtgacccaccagggcctgtccagccccgtgaccaagagcttcaaccggggcgagtgc

SEQ ID NO: 261 - DNA, 1350 bp, artificial
  Synthetic
gaagtccagctgcagcagtctgggcctgaggttgggaggcctgggtcctcagtcaagatttcttgcaaggcttctggctacacctttacagattacattatgcactgggtgaagcagagtcctggacaggggctggaatggataggatggattgatcctgagtatggtaggactgattatgctgagaagttcaaaaagaaggccacactgaccgcagatacatcctccagcacagcctacatccagcttagcagcctggcatctgaggacacagccacctatttttgtgctagatcggctcatactacgggatttggatttgcttactggggccaaggcactctggtgacagtgtcctcagctagcaccaagggacccagcgtgttccccctggcccccagcagcaagagcacatctggcggaacagccgccctgggctgcctggtgaaagactacttccccgagcccgtgaccgtgagctggaacagcggagccctgaccagcggcgtgcacacctttccagccgtgctgcagagcagcggcctgtacagcctgagcagcgtggtgacagtgccctctagcagcctgggcacccagacctacatctgcaacgtgaaccacaagcccagcaacaccaaggtggacaaaaaggtggaacccaagagctgcgacaagacccacacctgtcccccctgccctgcccctgaactgctgggcggaccctccgtgttcctgttccccccaaagcccaaggacaccctgatgatcagccggacccccgaagtgacctgcgtggtggtggacgtgtcccacgaggaccctgaagtgaagttcaattggtacgtggacggcgtggaagtgcacaacgccaagaccaagcccagagaggaacagtacaacagcacctaccgggtggtgtccgtgctgaccgtgctgcaccaggactggctgaacggcaaagagtacaagtgcaaggtgtccaacaaggccctgcctgctcccatcgagaaaaccatcagcaaggccaagggccagccccgcgagcctcaggtgtacacactgccccccagccgggacgagctgaccaagaaccaggtgtccctgacctgtctggtgaaaggcttctaccccagcgatatcgccgtggaatgggagagcaacggccagcccgagaacaactacaagaccaccccccctgtgctggacagcgacggctcattcttcctgtacagcaagctgaccgtggacaagagccggtggcagcagggcaacgtgttcagctgcagcgtgatgcacgaggccctgcacaaccactacacccagaagtccctgagcctgagccccggcaag

SEQ ID NO: 262 - protein, 612 aa, artificial [sequence omitted]

SEQ ID NO: 263 - DNA, 1836 bp, artificial
  Synthetic
gaagtccagctgcagcagtctgggcctgaggttgggaggcctgggtcctcagtcaagatttcttgcaaggcttctggctacacctttacagattacattatgcactgggtgaagcagagtcctggacaggggctggaatggataggatggattgatcctgagtatggtaggactgattatgctgagaagttcaaaaagaaggccacactgaccgcagatacatcctccagcacagcctacatccagcttagcagcctggcatctgaggacacagccacctatttttgtgctagatcggctcatactacgggatttggatttgcttactggggccaaggcactctggtgacagtgtcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagatgaaatcatgagatctttttctttgtcaacaaacttgcaagaaagtttaagaagtaaggaa

SEQ ID NO: 264 - protein, 219 aa, artificial
  Synthetic
DIVMTQGALPNPVPSGESASITCQSSESLLHSNGKTYLNWYLQRPGQSPQLLIYWMSTRAAGVSDRFSGSGSGTDFTLTISGVEAEDVGVYYCQQFLEYPPTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 265 - protein, 453 aa, artificial
  Synthetic
EVQLQQSGPEVGRPGSSVKISCKASGYIFTDYIMHWVKQSPGQGLEWIGWIDPEYGSTDYAEKFKKKATLTADTSSSTAYIQLSSLTSEDTATYFCARVAIITTVASGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 266 - DNA, 657 bp, artificial
  Synthetic
gatattgtgatgacccagggtgcactccccaatcctgtcccttctggagagtcagcttccatcacctgccagtctagtgagagtctgctgcacagcaatggcaagacatacttgaattggtatctgcagaggccaggacagtctcctcagctcctgatctattggatgtctacccgtgcagcaggagtctcagacaggttcagtggcagtgggtcaggaacagatttcacactgacaatcagtggcgtggaggctgaggatgtgggtgtgtattactgtcagcaatttctagagtatcctcccacgttcggttctgggaccaagctggagatcaagcgtacggtggcggcgcccagcgtgttcatcttcccacccagcgacgagcagctgaagtccggcacagccagcgtggtgtgcctgctgaacaacttctacccccgcgaggccaaggtgcagtggaaggtggacaacgccctgcagagcggcaacagccaggaaagcgtgaccgagcaggacagcaaggactccacctacagcctgagcagcaccctgaccctgagcaaggccgactacgagaagcacaaggtgtacgcctgcgaagtgacccaccagggcctgtccagccccgtgaccaagagcttcaaccggggcgagtgc

SEQ ID NO: 267 - DNA, 1359 bp, artificial
  Synthetic
gaagtccagctgcagcagtctgggcctgaggttgggaggcctgggtcctcagtcaagatttcttgcaaggcttctggctacatctttacagattacattatgcactgggtgaagcagagtcctggacaggggctggaatggataggatggattgatcctgagtatggtagtactgattatgctgagaagttcaaaaagaaggccacactgactgcagatacatcctccagcacagcctacatccagcttagcagcctgacatctgaggacacagccacctatttttgtgctagggtggcgattattactacagtggcctctggggggtttgcttactggggccaaggcactctggtgacagtgtcctcagctagcaccaagggacccagcgtgttccccctggcccccagcagcaagagcacatctggcggaacagccgccctgggctgcctggtgaaagactacttccccgagcccgtgaccgtgagctggaacagcggagccctgaccagcggcgtgcacacctttccagccgtgctgcagagcagcggcctgtacagcctgagcagcgtggtgacagtgccctctagcagcctgggcacccagacctacatctgcaacgtgaaccacaagcccagcaacaccaaggtggacaaaaaggtggaacccaagagctgcgacaagacccacacctgtcccccctgccctgcccctgaactgctgggcggaccctccgtgttcctgttccccccaaagcccaaggacaccctgatgatcagccggacccccgaagtgacctgcgtggtggtggacgtgtcccacgaggaccctgaagtgaagttcaattggtacgtggacggcgtggaagtgcacaacgccaagaccaagcccagagaggaacagtacaacagcacctaccgggtggtgtccgtgctgaccgtgctgcaccaggactggctgaacggcaaagagtacaagtgcaaggtgtccaacaaggccctgcctgctcccatcgagaaaaccatcagcaaggccaagggccagccccgcgagcctcaggtgtacacactgccccccagccgggacgagctgaccaagaaccaggtgtccctgacctgtctggtgaaaggcttctaccccagcgatatcgccgtggaatgggagagcaacggccagcccgagaacaactacaagaccaccccccctgtgctggacagcgacggctcattcttcctgtacagcaagctgaccgtggacaagagccggtggcagcagggcaacgtgttcagctgcagcgtgatgcacgaggccctgcacaaccactacacccagaagtccctgagcctgagccccggcaag

SEQ ID NO: 268 - protein, 615 aa, artificial
  Synthetic
EVQLQQSGPEVGRPGSSVKISCKASGYIFTDYIMHWVKQSPGQGLEWIGWIDPEYGSTDYAEKFKKKATLTADTSSSTAYIQLSSLTSEDTATYFCARVAIITTVASGGFAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRDEIMRSFSLSTNLQESLRSKE

SEQ ID NO: 269 - DNA, 1845 bp, artificial
  Synthetic
gaagtccagctgcagcagtctgggcctgaggttgggaggcctgggtcctcagtcaagatttcttgcaaggcttctggctacatctttacagattacattatgcactgggtgaagcagagtcctggacaggggctggaatggataggatggattgatcctgagtatggtagtactgattatgctgagaagttcaaaaagaaggccacactgactgcagatacatcctccagcacagcctacatccagcttagcagcctgacatctgaggacacagccacctatttttgtgctagggtggcgattattactacagtggcctctggggggtttgcttactggggccaaggcactctggtgacagtgtcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagatgaaatcatgagatctttttctttgtcaacaaacttgcaagaaagtttaagaagtaaggaa

SEQ ID NO: 270 - protein, 214 aa, artificial
  Synthetic
DIVMTQSPTSISISVGERVTMNCKASQNVDSDVDWYQQKTGQSPKLLIYKASNRYTGVPDRFTGSGSGTDFTFTISNMQAEDLAVYYCMQSNTHPRTFGGGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 271 - protein, 450 aa, artificial
  Synthetic
EVQLQQSGPEVGRPGSSVKISCKASGYTFTDSVMNWVKQSPGQGLEWIGWIDPEYGRTDVAEKFKKKATLTADSSSSTAYIYLSGLTSEDTATYFCARTKYNSGYGFPYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 272 - DNA, 642 bp, artificial
  Synthetic
gacattgtgatgactcagtctcccacatccatttccatatcagtaggagagagggtcaccatgaactgcaaggccagtcagaatgtggattctgatgtagactggtaccaacagaaaacagggcagtctcctaaactgcttatctacaaggcatccaaccggtacactggcgtccctgatcgcttcacaggcagtggatctggaacagatttcactttcaccatcagcaacatgcaggctgaagacctggctgtttattactgtatgcagtctaacacccatcctcggacgttcggtggaggcaccaagctggaattgaagcgtacggtggcggcgcccagcgtgttcatcttcccacccagcgacgagcagctgaagtccggcacagccagcgtggtgtgcctgctgaacaacttctacccccgcgaggccaaggtgcagtggaaggtggacaacgccctgcagagcggcaacagccaggaaagcgtgaccgagcaggacagcaaggactccacctacagcctgagcagcaccctgaccctgagcaaggccgactacgagaagcacaaggtgtacgcctgcgaagtgacccaccagggcctgtccagccccgtgaccaagagcttcaaccggggcgagtgc

SEQ ID NO: 273 - DNA, 1350 bp, artificial
  Synthetic
gaagtccagctgcagcagtctgggcctgaggttgggaggcctgggtcctcagtcaagatttcttgcaaggcttctggctacacctttacagattccgttatgaactgggtgaagcagagtcctggacaggggctggaatggataggatggattgatcctgagtatggtagaactgatgttgctgagaagttcaaaaagaaggccacactgactgcagattcatcctccagcacagcctacatctaccttagtggcctgacatctgaggacacagccacctatttttgtgctaggacaaagtataattcggggtacgggtttccttactggggccaaggctctctggtcactgtctcttcagctagcaccaagggacccagcgtgttccccctggcccccagcagcaagagcacatctggcggaacagccgccctgggctgcctggtgaaagactacttccccgagcccgtgaccgtgagctggaacagcggagccctgaccagcggcgtgcacacctttccagccgtgctgcagagcagcggcctgtacagcctgagcagcgtggtgacagtgccctctagcagcctgggcacccagacctacatctgcaacgtgaaccacaagcccagcaacaccaaggtggacaaaaaggtggaacccaagagctgcgacaagacccacacctgtcccccctgccctgcccctgaactgctgggcggaccctccgtgttcctgttccccccaaagcccaaggacaccctgatgatcagccggacccccgaagtgacctgcgtggtggtggacgtgtcccacgaggaccctgaagtgaagttcaattggtacgtggacggcgtggaagtgcacaacgccaagaccaagcccagagaggaacagtacaacagcacctaccgggtggtgtccgtgctgaccgtgctgcaccaggactggctgaacggcaaagagtacaagtgcaaggtgtccaacaaggccctgcctgctcccatcgagaaaaccatcagcaaggccaagggccagccccgcgagcctcaggtgtacacactgccccccagccgggacgagctgaccaagaaccaggtgtccctgacctgtctggtgaaaggcttctaccccagcgatatcgccgtggaatgggagagcaacggccagcccgagaacaactacaagaccaccccccctgtgctggacagcgacggctcattcttcctgtacagcaagctgaccgtggacaagagccggtggcagcagggcaacgtgttcagctgcagcgtgatgcacgaggccctgcacaaccactacacccagaagtccctgagcctgagccccggcaag

SEQ ID NO: 274 - protein, 612 aa, artificial
  Synthetic
EVQLQQSGPEVGRPGSSVKISCKASGYTFTDSVMNWVKQSPGQGLEWIGWIDPEYGRTDVAEKFKKKATLTADSSSSTAYIYLSGLTSEDTATYFCARTKYNSGYGFPYWGQGSLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRDEIMRSFSLSTNLQESLRSKE

SEQ ID NO: 275 - DNA, 1836 bp, artificial
  Synthetic
gaagtccagctgcagcagtctgggcctgaggttgggaggcctgggtcctcagtcaagatttcttgcaaggcttctggctacacctttacagattccgttatgaactgggtgaagcagagtcctggacaggggctggaatggataggatggattgatcctgagtatggtagaactgatgttgctgagaagttcaaaaagaaggccacactgactgcagattcatcctccagcacagcctacatctaccttagtggcctgacatctgaggacacagccacctatttttgtgctaggacaaagtataattcggggtacgggtttccttactggggccaaggctctctggtcactgtctcttcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagatgaaatcatgagatctttttctttgtcaacaaacttgcaagaaagtttaagaagtaaggaa

SEQ ID NO: 276 - protein, 213 aa, artificial
  Synthetic
QIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 277 - protein, 451 aa, artificial
  Synthetic
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 278 - DNA, 639 bp, artificial
  Synthetic
caaattgttctctcccagtctccagcaatcctgtctgcatctccaggggagaaggtcacaatgacttgcagggccagctcaagtgtaagttacatccactggttccagcagaagccaggatcctcccccaaaccctggatttatgccacatccaacctggcttctggagtccctgttcgcttcagtggcagtgggtctgggacttcttactctctcacaatcagcagagtggaggctgaagatgctgccacttattactgccagcagtggactagtaacccacccacgttcggaggggggaccaagctggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagttcaccggtgacaaagagcttcaacaggggagagtgt

SEQ ID NO: 279 - DNA, 1353 bp, artificial
  Synthetic
caggtacaactgcagcagcctggggctgagctggtgaagcctggggcctcagtgaagatgtcctgcaaggcttctggctacacatttaccagttacaatatgcactgggtaaaacagacacctggtcggggcctggaatggattggagctatttatcccggaaatggtgatacttcctacaatcagaagttcaaaggcaaggccacattgactgcagacaaatcctccagcacagcctacatgcagctcagcagcctgacatctgaggactctgcggtctattactgtgcaagatcgacttactacggcggtgactggtacttcaatgtctggggcgcagggaccacggtcaccgtctctgcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 280 - protein, 622 aa, artificial
  Synthetic
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGGSCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 281 - DNA, 1866 bp, artificial
  Synthetic
caggtacaactgcagcagcctggggctgagctggtgaagcctggggcctcagtgaagatgtcctgcaaggcttctggctacacatttaccagttacaatatgcactgggtaaaacagacacctggtcggggcctggaatggattggagctatttatcccggaaatggtgatacttcctacaatcagaagttcaaaggcaaggccacattgactgcagacaaatcctccagcacagcctacatgcagctcagcagcctgacatctgaggactctgcggtctattactgtgcaagatcgacttactacggcggtgactggtacttcaatgtctggggcgcagggaccacggtcaccgtctctgcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatccggaggcggcgggagctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaa

SEQ ID NO: 282 - protein, 622 aa, artificial
  Synthetic
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGGSCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVAAEIMRSFSLSTNLQESLRSKE

SEQ ID NO: 283 - DNA, 1866 bp, artificial
  Synthetic
caggtacaactgcagcagcctggggctgagctggtgaagcctggggcctcagtgaagatgtcctgcaaggcttctggctacacatttaccagttacaatatgcactgggtaaaacagacacctggtcggggcctggaatggattggagctatttatcccggaaatggtgatacttcctacaatcagaagttcaaaggcaaggccacattgactgcagacaaatcctccagcacagcctacatgcagctcagcagcctgacatctgaggactctgcggtctattactgtgcaagatcgacttactacggcggtgactggtacttcaatgtctggggcgcagggaccacggtcaccgtctctgcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatccggaggcggcgggagctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcgcagcagaaatcatgagatctttttctttgtcaacaaacttgcaagaaagtttaagaagtaaggaa

SEQ ID NO: 284 - protein, 622 aa, artificial
  Synthetic
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGGSCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRGEIMRSFSLSTNLQESLRSKE

SEQ ID NO: 285 - DNA, 1866 bp, artificial
  Synthetic
caggtacaactgcagcagcctggggctgagctggtgaagcctggggcctcagtgaagatgtcctgcaaggcttctggctacacatttaccagttacaatatgcactgggtaaaacagacacctggtcggggcctggaatggattggagctatttatcccggaaatggtgatacttcctacaatcagaagttcaaaggcaaggccacattgactgcagacaaatcctccagcacagcctacatgcagctcagcagcctgacatctgaggactctgcggtctattactgtgcaagatcgacttactacggcggtgactggtacttcaatgtctggggcgcagggaccacggtcaccgtctctgcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatccggaggcggcgggagctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagaggagaaatcatgagatctttttctttgtcaacaaacttgcaagaaagtttaagaagtaaggaa

SEQ ID NO: 286 - protein, 622 aa, artificial
  Synthetic
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGGSCDLPQTHSLGSRRTLMLLAQMRRISLFSCLKDAHDFGFPQEEFGNQFQKAETIPVLYNMISQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 287 - DNA, 1866 bp, artificial
  Synthetic
caggtacaactgcagcagcctggggctgagctggtgaagcctggggcctcagtgaagatgtcctgcaaggcttctggctacacatttaccagttacaatatgcactgggtaaaacagacacctggtcggggcctggaatggattggagctatttatcccggaaatggtgatacttcctacaatcagaagttcaaaggcaaggccacattgactgcagacaaatcctccagcacagcctacatgcagctcagcagcctgacatctgaggactctgcggtctattactgtgcaagatcgacttactacggcggtgactggtacttcaatgtctggggcgcagggaccacggtcaccgtctctgcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatccggaggcggcgggagctgtgatctgcctcaaacccacagcctgggtagcaggaggaccttgatgctcctggcacagatgaggagaatctctcttttctcctgcttgaaggacgcacatgactttggatttccccaggaggagtttggcaaccagttccaaaaggctgaaaccatccctgtcctctataacatgatcagccagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaa

SEQ ID NO: 288 - protein, 622 aa, artificial
  Synthetic
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGGSCDLPQTHSLGSRRTLMLLAQMRRISLFSCLKDRHDFGFPQEEFGNQFQKAETIPVLYNMISQIFNLFSTKDSSAAWDETLLDKFYTELYQQLNDLEACVIQGVGVTETPLMKEDSILAVRKYFQRITLYLKEKKYSPCAWEVVAAEIMRSFSLSTNLQESLRSKE

SEQ ID NO: 289 - DNA, 1866 bp, artificial
  Synthetic
caggtacaactgcagcagcctggggctgagctggtgaagcctggggcctcagtgaagatgtcctgcaaggcttctggctacacatttaccagttacaatatgcactgggtaaaacagacacctggtcggggcctggaatggattggagctatttatcccggaaatggtgatacttcctacaatcagaagttcaaaggcaaggccacattgactgcagacaaatcctccagcacagcctacatgcagctcagcagcctgacatctgaggactctgcggtctattactgtgcaagatcgacttactacggcggtgactggtacttcaatgtctggggcgcagggaccacggtcaccgtctctgcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatccggaggcggcgggagctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctctataacatgatcagccagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcgcagcagaaatcatgagatctttttctttgtcaacaaacttgcaagaaagtttaagaagtaaggaa

SEQ ID NO: 290 - protein, 213 aa, artificial
  Synthetic
DIQMTQSPSTLSASVGDRVTITCKCQLSVGYMHWYQQKPGKAPKLLIYDTSKLASGVPSRFSGSGSGTEFTLTISSLQPDDFATYYCFQGSGYPFTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 291 - protein, 450 aa, artificial
  Synthetic
QVTLRESGPALVKPTQTLTLTCTFSGFSLSTSGMSVGWIRQPPGKALEWLADIWWDDKKDYNPSLKSRLTISKDTSKNQVVLKVTNMDPADTATYYCARSMITNWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 292 - DNA, 639 bp, artificial
  Synthetic
gatatccagatgacccagtctccttccaccctgtctgcatctgtgggagacagagtcaccatcacttgcaagtgccagctgagcgtgggctacatgcactggtatcagcagaaaccagggaaagcccctaagctcctgatctatgacacaagcaaattggcatctggggtcccatcaaggttcagcggcagtggatctgggacagaatttactctcaccatcagcagcctgcagcctgatgatttcgcaacttattactgcttccagggttccgggtatccgtttacgttcggaggggggaccaagctcgaaataaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagttcaccggtgacaaagagcttcaacaggggagagtgt

SEQ ID NO: 293 - DNA, 1350 bp, artificial
  Synthetic
caggtcactttgagggagtctggtcctgccctggtgaaacccacacagaccctcacactgacctgcaccttctctgggttttcactgagcacttctggtatgagtgttggctggattcggcagcccccagggaaggccctggagtggcttgcagacatttggtgggatgacaaaaaggactataatccaagcctgaagagccgcctcacaatctccaaggatacctccaaaaaccaggtggtccttaaagtgaccaacatggaccctgctgatactgccacttactactgtgctcggtctatgatcacgaactggtacttcgatgtctggggcgctgggaccacggtcaccgtgagttcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 294 - protein, 621 aa, artificial
  Synthetic
QVTLRESGPALVKPTQTLTLTCTFSGFSLSTSGMSVGWIRQPPGKALEWLADIWWDDKKDYNPSLKSRLTISKDTSKNQVVLKVTNMDPADTATYYCARSMITNWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGGSCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 295 - DNA, 1863 bp, artificial
  Synthetic
caggtcactttgagggagtctggtcctgccctggtgaaacccacacagaccctcacactgacctgcaccttctctgggttttcactgagcacttctggtatgagtgttggctggattcggcagcccccagggaaggccctggagtggcttgcagacatttggtgggatgacaaaaaggactataatccaagcctgaagagccgcctcacaatctccaaggatacctccaaaaaccaggtggtccttaaagtgaccaacatggaccctgctgatactgccacttactactgtgctcggtctatgatcacgaactggtacttcgatgtctggggcgctgggaccacggtcaccgtgagttcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatccggaggcggcgggagctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaa

SEQ ID NO: 296 - protein, 394 aa, artificial
  Synthetic
QVTLRESGPALVKPTQTLTLTCTFSGFSLSTSGMSVGWIRQPPGKALEWLADIWWDDKKDYNPSLKSRLTISKDTSKNQVVLKVTNMDPADTATYYCARSMITNWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCSGGGGSCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 297 - DNA, 1182 bp, artificial
  Synthetic
caggtcactttgagggagtctggtcctgccctggtgaaacccacacagaccctcacactgacctgcaccttctctgggttttcactgagcacttctggtatgagtgttggctggattcggcagcccccagggaaggccctggagtggcttgcagacatttggtgggatgacaaaaaggactataatccaagcctgaagagccgcctcacaatctccaaggatacctccaaaaaccaggtggtccttaaagtgaccaacatggaccctgctgatactgccacttactactgtgctcggtctatgatcacgaactggtacttcgatgtctggggcgctgggaccacggtcaccgtgagttcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgttccggaggcggcgggagctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaa

SEQ ID NO: 298 - protein, 394 aa, artificial
  Synthetic
QVTLRESGPALVKPTQTLTLTCTFSGFSLSTSGMSVGWIRQPPGKALEWLADIWWDDKKDYNPSLKSRLTISKDTSKNQVVLKVTNMDPADTATYYCARSMITNWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCSGGGGSCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRDEIMRSFSLSTNLQESLRSKE

SEQ ID NO: 299 - DNA, 1182 bp, artificial
  Synthetic
caggtcactttgagggagtctggtcctgccctggtgaaacccacacagaccctcacactgacctgcaccttctctgggttttcactgagcacttctggtatgagtgttggctggattcggcagcccccagggaaggccctggagtggcttgcagacatttggtgggatgacaaaaaggactataatccaagcctgaagagccgcctcacaatctccaaggatacctccaaaaaccaggtggtccttaaagtgaccaacatggaccctgctgatactgccacttactactgtgctcggtctatgatcacgaactggtacttcgatgtctggggcgctgggaccacggtcaccgtgagttcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgttccggaggcggcgggagctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagatgaaatcatgagatctttttctttgtcaacaaacttgcaagaaagtttaagaagtaaggaa

SEQ ID NO: 300 - protein, 214 aa, artificial
  Synthetic
DIQMTQSPASLSASVGETVTLTCRASENIHNYLAWYQQKQGKSPQLLVYNVKTLADGVPSRFSGSGSGTQYSLKINSLQPEDFGSYYCQHFWSSPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 301 - protein, 449 aa, artificial
  Synthetic
DVQLQESGPGLVKPSQSLSLTCTVTGHSITSDYAWNWIRQFPGDKLEWMGYISYSGYTTYNPSLKSRVSITRDTSKNQFFLQLNSVTTEDTATYFCARDLDYGPWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 302 - DNA, 642 bp, artificial
  Synthetic
gacatccagatgactcagtctccagcctccctatctgcatctgtgggagaaactgtcaccctcacatgtcgagcaagtgagaatattcacaattatttagcatggtatcagcagaaacagggaaaatctcctcagctcctggtctataatgtaaaaaccttagcagatggtgtgccatcaaggttcagtggcagtggatcaggaacacaatattctctcaagatcaacagcctgcagcctgaagattttgggagttattactgtcaacatttttggagtagtccgtggacgttcggtggaggcaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagttcaccggtgacaaagagcttcaacaggggagagtgt

SEQ ID NO: 303 - DNA, 1347 bp, artificial
  Synthetic
gatgtgcagcttcaggagtcgggacctggcctggtgaaaccttctcagtctctgtccctcacctgcactgtcactggccactcaatcaccagtgattatgcctggaactggatccggcagtttccaggagacaaactggagtggatgggctacataagctacagtggttacactacctacaacccatctctgaaaagtcgagtctctatcactcgagacacatccaagaaccagttcttcctgcagttgaattctgtgactactgaggacacagccacatacttctgtgcaagagaccttgattacggcccctggtttgcttactggggccaagggactctggtcactgtctctgcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 304 - protein, 584 aa, artificial
  Synthetic
DVQLQESGPGLVKPSQSLSLTCTVTGHSITSDYAWNWIRQFPGDKLEWMGYISYSGYTTYNPSLKSRVSITRDTSKNQFFLQLNSVTTEDTATYFCARDLDYGPWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGGSHKCDITLQEIIKTLNSLTEQKTLCTELTVTDIFAASKNTTEKETFCRAATVLRQFYSHHEKDTRCLGATAQQFHRHKQLIRFLKRLDRNLWGLAGLNSCPVKEANQSTLENFLERLKTIMREKYSKCSS

SEQ ID NO: 305 - DNA, 1752 bp, artificial
  Synthetic
gatgtgcagcttcaggagtcgggacctggcctggtgaaaccttctcagtctctgtccctcacctgcactgtcactggccactcaatcaccagtgattatgcctggaactggatccggcagtttccaggagacaaactggagtggatgggctacataagctacagtggttacactacctacaacccatctctgaaaagtcgagtctctatcactcgagacacatccaagaaccagttcttcctgcagttgaattctgtgactactgaggacacagccacatacttctgtgcaagagaccttgattacggcccctggtttgcttactggggccaagggactctggtcactgtctctgcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatccggaggaggaggaagccataagtgcgacatcaccctgcaggagatcattaagaccctgaacagcctgactgagcagaaaaccctgtgtacagaactgacagtgactgatatttttgccgcttctaagaacactaccgagaaagaaaccttctgcagggcagccacagtgctgcgccagttttattcccaccatgaaaaggacactcggtgtctgggcgctaccgcacagcagttccaccgacataagcagctgatccggtttctgaaacggctggatagaaacctgtggggactggcaggcctgaacagctgtccagtgaaagaggccaaccagagtaccctggaaaacttcctggagagactgaaaacaattatgcgagagaaatactcaaaatgtagcagc

SEQ ID NO: 306 - protein, 584 aa, artificial
  Synthetic
DVQLQESGPGLVKPSQSLSLTCTVTGHSITSDYAWNWIRQFPGDKLEWMGYISYSGYTTYNPSLKSRVSITRDTSKNQFFLQLNSVTTEDTATYFCARDLDYGPWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGGSHKCDITLQEIIKTLNSLTEQKTLCTELTVTDIFAASKNTTEKETFCRAATVLRQFYSHHEKDTRCLGATAQQFHRHKQLIRFLKRLDQNLWGLAGLNSCPVKEANQSTLENFLERLKTIMREKYSKCSS

SEQ ID NO: 307 - DNA, 1752 bp, artificial
  Synthetic
gatgtgcagcttcaggagtcgggacctggcctggtgaaaccttctcagtctctgtccctcacctgcactgtcactggccactcaatcaccagtgattatgcctggaactggatccggcagtttccaggagacaaactggagtggatgggctacataagctacagtggttacactacctacaacccatctctgaaaagtcgagtctctatcactcgagacacatccaagaaccagttcttcctgcagttgaattctgtgactactgaggacacagccacatacttctgtgcaagagaccttgattacggcccctggtttgcttactggggccaagggactctggtcactgtctctgcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatccggaggaggaggaagccataagtgcgacatcaccctgcaggagatcattaagaccctgaacagcctgactgagcagaaaaccctgtgtacagaactgacagtgactgatatttttgccgcttctaagaacactaccgagaaagaaaccttctgcagggcagccacagtgctgcgccagttttattcccaccatgaaaaggacactcggtgtctgggcgctaccgcacagcagttccaccgacataagcagctgatccggtttctgaaacggctggatcaaaacctgtggggactggcaggcctgaacagctgtccagtgaaagaggccaaccagagtaccctggaaaacttcctggagagactgaaaacaattatgcgagagaaatactcaaaatgtagcagc

SEQ ID NO: 308 - protein, 649 aa, artificial
  Synthetic
DVQLQESGPGLVKPSQSLSLTCTVTGHSITSDYAWNWIRQFPGDKLEWMGYISYSGYTTYNPSLKSRVSITRDTSKNQFFLQLNSVTTEDTATYFCARDLDYGPWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGGSGGGGSGGGGSPVPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 309 - DNA, 1947 bp, artificial
  Synthetic
gatgtgcagcttcaggagtcgggacctggcctggtgaaaccttctcagtctctgtccctcacctgcactgtcactggccactcaatcaccagtgattatgcctggaactggatccggcagtttccaggagacaaactggagtggatgggctacataagctacagtggttacactacctacaacccatctctgaaaagtcgagtctctatcactcgagacacatccaagaaccagttcttcctgcagttgaattctgtgactactgaggacacagccacatacttctgtgcaagagaccttgattacggcccctggtttgcttactggggccaagggactctggtcactgtctctgcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatccggaggtggaggttcagggggagggggctctggaggcggcgggagcccagtacccccaggagaagattccaaagatgtagccgccccacacagacagccactcacctcttcagaacgaattgacaaacaaattcggtacatcctcgacggcatctcagccctgagaaaggagacatgtaacaagagtaacatgtgtgaaagcagcaaagaggcactggcagaaaacaacctgaaccttccaaagatggctgaaaaagatggatgcttccaatctggattcaatgaggagacttgcctggtgaaaatcatcactggtcttttggagtttgaggtatacctggagtacctccagaacagatttgagagtagtgaggaacaagccagagctgtgcagatgagtacaaaagtcctgatccagttcctgcagaaaaaggcaaagaatctggatgcaataaccacccctgacccaaccacaaatgccagcctgctgacgaagctgcaggcacagaaccagtggctgcaggacatgacaactcatctcattctgcgcagctttaaggagttcctgcagtccagcctgagggctcttcggcaaatg

SEQ ID NO: 310 - protein, 649 aa, artificial
  Synthetic
DVQLQESGPGLVKPSQSLSLTCTVTGHSITSDYAWNWIRQFPGDKLEWMGYISYSGYTTYNPSLKSRVSITRDTSKNQFFLQLNSVTTEDTATYFCARDLDYGPWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGGSGGGGSGGGGSPVPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLEALRQM

SEQ ID NO: 311 - DNA, 1947 bp, artificial
  Synthetic
gatgtgcagcttcaggagtcgggacctggcctggtgaaaccttctcagtctctgtccctcacctgcactgtcactggccactcaatcaccagtgattatgcctggaactggatccggcagtttccaggagacaaactggagtggatgggctacataagctacagtggttacactacctacaacccatctctgaaaagtcgagtctctatcactcgagacacatccaagaaccagttcttcctgcagttgaattctgtgactactgaggacacagccacatacttctgtgcaagagaccttgattacggcccctggtttgcttactggggccaagggactctggtcactgtctctgcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatccggaggtggaggttcagggggagggggctctggaggcggcgggagcccagtacccccaggagaagattccaaagatgtagccgccccacacagacagccactcacctcttcagaacgaattgacaaacaaattcggtacatcctcgacggcatctcagccctgagaaaggagacatgtaacaagagtaacatgtgtgaaagcagcaaagaggcactggcagaaaacaacctgaaccttccaaagatggctgaaaaagatggatgcttccaatctggattcaatgaggagacttgcctggtgaaaatcatcactggtcttttggagtttgaggtatacctggagtacctccagaacagatttgagagtagtgaggaacaagccagagctgtgcagatgagtacaaaagtcctgatccagttcctgcagaaaaaggcaaagaatctggatgcaataaccacccctgacccaaccacaaatgccagcctgctgacgaagctgcaggcacagaaccagtggctgcaggacatgacaactcatctcattctgcgcagctttaaggagttcctgcagtccagcctggaggctcttcggcaaatg

SEQ ID NO: 312 - protein, 215 aa, artificial
  Synthetic
SIVMTQTPKFLLVSAGDRVTITCKASQSVSNDVAWYQQKPGQSPKLLIYYASNRYTGVPDRFTGSGYGTDFTFTISTVQAEDLAVYFCQQDYSSPPWTFGGGTKLEIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 313 - protein, 450 aa, artificial
  Synthetic
QVQLKQSGPGLVQPSQSLSLTCTVSGFSLTSYGVHWVRQPPGKGLEWLGVIWSGGSTDYNAAFISRLSIRKDNSKSQVFFKMNSLQADDTAIYYCARTFTTSTSAWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 314 - DNA, 645 bp, artificial
  Synthetic
agtattgtgatgacccagactcccaaattcctgcttgtatcagcaggagacagggttaccataacctgcaaggccagtcagagtgtgagtaatgatgtagcttggtaccaacagaagccagggcagtctcctaaactgcttatatattatgcatccaatcgctacactggagtccctgatcgcttcactggcagtggatatgggacggatttcactttcaccatcagcactgtgcaggctgaagacctggcagtttatttctgtcagcaggattatagctctcctccgtggacgttcggtggaggcaccaagctggaaatcagacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagttcaccggtgacaaagagcttcaacaggggagagtgt

SEQ ID NO: 315 - DNA, 1350 bp, artificial
  Synthetic
caggtgcagctgaagcagtcaggacctggcctagtgcagccctcacagagcctgtccctgacctgcacagtctctggtttctcattaactagttatggcgtacactgggttcgccagcctccaggaaagggtctggagtggctgggagtgatctggagtggtggaagcacagactataatgctgctttcatatccagactgagcatcaggaaggacaactccaagagccaagtcttctttaaaatgaacagtctgcaagctgatgacacagccatatactactgtgccagaacctttactacgtctacctcggcctggtttgcttactggggccaagggactctggtcactgtctctgcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 316 - protein, 612 aa, artificial
  Synthetic
QVQLKQSGPGLVQPSQSLSLTCTVSGFSLTSYGVHWVRQPPGKGLEWLGVIWSGGSTDYNAAFISRLSIRKDNSKSQVFFKMNSLQADDTAIYYCARTFTTSTSAWFAYWGQGTLVTVSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRDEIMRSFSLSTNLQESLRSKE

SEQ ID NO: 317 - DNA, 1836 bp, artificial
  Synthetic
caggtgcagctgaagcagtcaggacctggcctagtgcagccctcacagagcctgtccctgacctgcacagtctctggtttctcattaactagttatggcgtacactgggttcgccagcctccaggaaagggtctggagtggctgggagtgatctggagtggtggaagcacagactataatgctgctttcatatccagactgagcatcaggaaggacaactccaagagccaagtcttctttaaaatgaacagtctgcaagctgatgacacagccatatactactgtgccagaacctttactacgtctacctcggcctggtttgcttactggggccaagggactctggtcactgtctctgcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagatgaaatcatgagatctttttctttgtcaacaaacttgcaagaaagtttaagaagtaaggaa

SEQ ID NO: 318 - protein, 394 aa, artificial
  Synthetic
QVQLKQSGPGLVQPSQSLSLTCTVSGFSLTSYGVHWVRQPPGKGLEWLGVIWSGGSTDYNAAFISRLSIRKDNSKSQVFFKMNSLQADDTAIYYCARTFTTSTSAWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCSGGGGSCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 319 - DNA, 1182 bp, artificial
  Synthetic
caggtgcagctgaagcagtcaggacctggcctagtgcagccctcacagagcctgtccctgacctgcacagtctctggtttctcattaactagttatggcgtacactgggttcgccagcctccaggaaagggtctggagtggctgggagtgatctggagtggtggaagcacagactataatgctgctttcatatccagactgagcatcaggaaggacaactccaagagccaagtcttctttaaaatgaacagtctgcaagctgatgacacagccatatactactgtgccagaacctttactacgtctacctcggcctggtttgcttactggggccaagggactctggtcactgtctctgcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgttccggaggcggcgggagctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaa

SEQ ID NO: 320 - protein, 394 aa, artificial
  Synthetic
QVQLKQSGPGLVQPSQSLSLTCTVSGFSLTSYGVHWVRQPPGKGLEWLGVIWSGGSTDYNAAFISRLSIRKDNSKSQVFFKMNSLQADDTAIYYCARTFTTSTSAWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCSGGGGSCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRDEIMRSFSLSTNLQESLRSKE

SEQ ID NO: 321 - DNA, 1182 bp, artificial
  Synthetic
caggtgcagctgaagcagtcaggacctggcctagtgcagccctcacagagcctgtccctgacctgcacagtctctggtttctcattaactagttatggcgtacactgggttcgccagcctccaggaaagggtctggagtggctgggagtgatctggagtggtggaagcacagactataatgctgctttcatatccagactgagcatcaggaaggacaactccaagagccaagtcttctttaaaatgaacagtctgcaagctgatgacacagccatatactactgtgccagaacctttactacgtctacctcggcctggtttgcttactggggccaagggactctggtcactgtctctgcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgttccggaggcggcgggagctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagatgaaatcatgagatctttttctttgtcaacaaacttgcaagaaagtttaagaagtaaggaa

SEQ ID NO: 322 - protein, 650 aa, artificial
  Synthetic
QVQLKQSGPGLVQPSQSLSLTCTVSGFSLTSYGVHWVRQPPGKGLEWLGVIWSGGSTDYNAAFISRLSIRKDNSKSQVFFKMNSLQADDTAIYYCARTFTTSTSAWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGGSGGGGSGGGGSPVPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 323 - DNA, 1950 bp, artificial
  Synthetic
caggtgcagctgaagcagtcaggacctggcctagtgcagccctcacagagcctgtccctgacctgcacagtctctggtttctcattaactagttatggcgtacactgggttcgccagcctccaggaaagggtctggagtggctgggagtgatctggagtggtggaagcacagactataatgctgctttcatatccagactgagcatcaggaaggacaactccaagagccaagtcttctttaaaatgaacagtctgcaagctgatgacacagccatatactactgtgccagaacctttactacgtctacctcggcctggtttgcttactggggccaagggactctggtcactgtctctgcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatccggaggtggaggttcagggggagggggctctggaggcggcgggagcccagtacccccaggagaagattccaaagatgtagccgccccacacagacagccactcacctcttcagaacgaattgacaaacaaattcggtacatcctcgacggcatctcagccctgagaaaggagacatgtaacaagagtaacatgtgtgaaagcagcaaagaggcactggcagaaaacaacctgaaccttccaaagatggctgaaaaagatggatgcttccaatctggattcaatgaggagacttgcctggtgaaaatcatcactggtcttttggagtttgaggtatacctggagtacctccagaacagatttgagagtagtgaggaacaagccagagctgtgcagatgagtacaaaagtcctgatccagttcctgcagaaaaaggcaaagaatctggatgcaataaccacccctgacccaaccacaaatgccagcctgctgacgaagctgcaggcacagaaccagtggctgcaggacatgacaactcatctcattctgcgcagctttaaggagttcctgcagtccagcctgagggctcttcggcaaatg

SEQ ID NO: 324 - protein, 650 aa, artificial
  Synthetic
QVQLKQSGPGLVQPSQSLSLTCTVSGFSLTSYGVHWVRQPPGKGLEWLGVIWSGGSTDYNAAFISRLSIRKDNSKSQVFFKMNSLQADDTAIYYCARTFTTSTSAWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGGSGGGGSGGGGSPVPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLEALRQM

SEQ ID NO: 325 - DNA, 1950 bp, artificial
  Synthetic
caggtgcagctgaagcagtcaggacctggcctagtgcagccctcacagagcctgtccctgacctgcacagtctctggtttctcattaactagttatggcgtacactgggttcgccagcctccaggaaagggtctggagtggctgggagtgatctggagtggtggaagcacagactataatgctgctttcatatccagactgagcatcaggaaggacaactccaagagccaagtcttctttaaaatgaacagtctgcaagctgatgacacagccatatactactgtgccagaacctttactacgtctacctcggcctggtttgcttactggggccaagggactctggtcactgtctctgcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatccggaggtggaggttcagggggagggggctctggaggcggcgggagcccagtacccccaggagaagattccaaagatgtagccgccccacacagacagccactcacctcttcagaacgaattgacaaacaaattcggtacatcctcgacggcatctcagccctgagaaaggagacatgtaacaagagtaacatgtgtgaaagcagcaaagaggcactggcagaaaacaacctgaaccttccaaagatggctgaaaaagatggatgcttccaatctggattcaatgaggagacttgcctggtgaaaatcatcactggtcttttggagtttgaggtatacctggagtacctccagaacagatttgagagtagtgaggaacaagccagagctgtgcagatgagtacaaaagtcctgatccagttcctgcagaaaaaggcaaagaatctggatgcaataaccacccctgacccaaccacaaatgccagcctgctgacgaagctgcaggcacagaaccagtggctgcaggacatgacaactcatctcattctgcgcagctttaaggagttcctgcagtccagcctggaggctcttcggcaaatg

SEQ ID NO: 326 - protein, 214 aa, artificial
  Synthetic
DIQMTQSTSSLSASLGDRVTISCSASQGINNYLNWYQQKPDGTVELLIYYTSTLQSGVPSRFSGSGSGTDYSLTISNLEPEDIGTYYCQQYSKLPRTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 327 - protein, 452 aa, artificial
  Synthetic
QVQLQQSGSELMMPGASVKISCKATGYTFSNYWIEWVKQRPGHGLEWIGEILPGTGRTIYNEKFKGKATFTADISSNTVQMQLSSLTSEDSAVYYCARRDYYGNFYYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 328 - DNA, 642 bp, artificial
  Synthetic
gacatccagatgacccagagcacatcctctctgagcgcctccctgggcgatcgcgtgactatcagttgcagcgcttcccaagggattaacaattacctcaactggtaccagcagaagcccgacggaaccgtcgagctgctcatctattacacatctacgctgcaaagcggcgtgccttccaggttctcagggagcggttccggaactgattactctctgaccattagcaatctcgaaccagaagacatcggcacatattactgtcagcagtactccaagctgccccggacttttgggggaggcaccaaactggagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagttcaccggtgacaaagagcttcaacaggggagagtgt

SEQ ID NO: 329 - DNA, 1356 bp, artificial
  Synthetic
caggtgcagctccaacagagcggctccgaactgatgatgcctggggcctctgtcaagatttcctgcaaagctaccggctacacattcagcaactattggattgagtgggtgaagcagcgcccagggcacggtctggagtggatcggagagatcctgccaggcaccgggaggactatttacaatgaaaagtttaaaggaaaggccacattcaccgcagacatctctagcaacactgttcaaatgcagctctcctctctgacctccgaggatagcgccgtgtattactgtgctcggagagactactatggcaatttttactatgctatggattactggggacagggcacatctgtgaccgtcagctccgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 330 - protein, 614 aa, artificial
  Synthetic
QVQLQQSGSELMMPGASVKISCKATGYTFSNYWIEWVKQRPGHGLEWIGEILPGTGRTIYNEKFKGKATFTADISSNTVQMQLSSLTSEDSAVYYCARRDYYGNFYYAMDYWGQGTSVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRDEIMRSFSLSTNLQESLRSKE

SEQ ID NO: 331 - DNA, 1842 bp, artificial
  Synthetic
caggtgcagctccaacagagcggctccgaactgatgatgcctggggcctctgtcaagatttcctgcaaagctaccggctacacattcagcaactattggattgagtgggtgaagcagcgcccagggcacggtctggagtggatcggagagatcctgccaggcaccgggaggactatttacaatgaaaagtttaaaggaaaggccacattcaccgcagacatctctagcaacactgttcaaatgcagctctcctctctgacctccgaggatagcgccgtgtattactgtgctcggagagactactatggcaatttttactatgctatggattactggggacagggcacatctgtgaccgtcagctccgctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagatgaaatcatgagatctttttctttgtcaacaaacttgcaagaaagtttaagaagtaaggaa

SEQ ID NO: 332 - protein, 214 aa, artificial
  Synthetic
SSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 333 - protein, 448 aa, artificial
  Synthetic
QVQLVQSGAEVKKPGSSVKVSCKASGGTFSSYAISWVRQAPGQGLEWMGGIIPIFGTANYAQKFQGRVTITADESTSTAYMELSSLRSDDTAVYYCARALDPITFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 334 - DNA, 642 bp, artificial
  Synthetic
tctagcgagctgacccaagatcctgccgtgtctgtggctctgggccagaccgtgcggatcacctgtcagggcgacagcctgcggagctactacgccagctggtatcagcagaagcccggccaggcccccgtgctggtcatctacggcaagaacaaccggcccagcggcatccccgacagattcagcggcagcagcagcggcaacaccgccagcctgaccatcactggcgcccaggccgaggacgaggccgactactactgcaacagccgggacagctccggcaaccacgtggtgtttggcggaggcaccaagctgaccgtcctaggtcagcccaaggccgctcccagcgtgaccctgttccccccaagcagcgaggaactgcaggccaacaaggccaccctggtgtgcctgatcagcgacttctaccctggggccgtgaccgtggcctggaaggccgatagcagccctgtgaaggccggcgtggaaaccaccaccccctccaagcagagcaacaacaaatacgccgccagcagctacctgtccctgacccccgagcagtggaagtcccaccggtcctacagctgccaggtgacacacgagggcagcaccgtggaaaagaccgtggcccccaccgagtgcagc

SEQ ID NO: 335 - DNA, 1344 bp, artificial
  Synthetic
caggtgcagctggtgcagtctggcgccgaagtgaagaaacccggcagcagcgtgaaggtgtcctgcaaggccagcggcggcaccttcagcagctacgccatcagctgggtccgacaggccccagggcagggcctggaatggatgggcggcatcatccccatcttcggcaccgccaactacgcccagaaattccagggcagagtgaccatcaccgccgacgagagcaccagcaccgcctacatggaactgagcagcctgcggagcgacgacaccgccgtgtactactgcgccagagccctggaccccatcaccttcgacagctggggccagggcaccctggtcaccgtgtccagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 336 - protein, 610 aa, artificial
  Synthetic
QVQLVQSGAEVKKPGSSVKVSCKASGGTFSSYAISWVRQAPGQGLEWMGGIIPIFGTANYAQKFQGRVTITADESTSTAYMELSSLRSDDTAVYYCARALDPITFDSWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRDEIMRSFSLSTNLQESLRSKE

SEQ ID NO: 337 - DNA, 1830 bp, artificial
  Synthetic
caggtgcagctggtgcagtctggcgccgaagtgaagaaacccggcagcagcgtgaaggtgtcctgcaaggccagcggcggcaccttcagcagctacgccatcagctgggtccgacaggccccagggcagggcctggaatggatgggcggcatcatccccatcttcggcaccgccaactacgcccagaaattccagggcagagtgaccatcaccgccgacgagagcaccagcaccgcctacatggaactgagcagcctgcggagcgacgacaccgccgtgtactactgcgccagagccctggaccccatcaccttcgacagctggggccagggcaccctggtcaccgtgtccagcgctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagatgaaatcatgagatctttttctttgtcaacaaacttgcaagaaagtttaagaagtaaggaa

SEQ ID NO: 338 - protein, 214 aa, artificial
  Synthetic
DIVMTQSQKFMSTSVGDRVSVPCKASQNVDTHVAWYQQKPGQSPKPLIYSAFYRYSGVPDRFTGSGSGTDFTLTISNVKSEDLAEYFCQQYKNYPFTFGSGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 339 - protein, 449 aa, artificial
  Synthetic
QVQLQQPGSELVRPGASVKLSCKASGYTFTSYWMHWVKQRHGQGLDWIGNIYPGSGNTQYGEKFKSKGTLTVDTSSSTAYMHLSSLTSEDSAVYYCTRRDANFEGFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 340 - DNA, 642 bp, artificial
  Synthetic
gacattgtgatgacccagtctcaaaaattcatgtccacatcagtcggagacagggtcagcgtcccctgtaaggccagtcagaatgtggatactcatgtagcctggtatcaacagaaaccagggcaatctcctaaaccactgatttactcggcattttaccggtacagtggagtccctgatcgcttcacaggcagtggatctgggacagatttcactctcaccatctccaatgtgaagtctgaagacttggcagagtatttctgtcagcaatataaaaactatcctttcacgttcggctcggggacaaagttggaagtgaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagttcaccggtgacaaagagcttcaacaggggagagtgt

SEQ ID NO: 341 - DNA, 1347 bp, artificial
  Synthetic
caggtccaactgcagcaacctgggtctgagctggtgaggcctggagcttcagtgaagctgtcctgcaaggcttctggctacacattcaccagttactggatgcactgggtgaaacagaggcatggacaaggccttgactggattggaaatatttatcctggtagtggtaatactcagtacggtgagaagttcaagagcaagggcacactgactgtagacacatcctccagcacagcctacatgcacctcagcagcctgacatctgaagactctgcggtctattactgtacaagaagggatgctaatttcgagggttttgcttattggggccaggggactctggtcactgtctctgcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 342 - protein, 611 aa, artificial
  Synthetic
QVQLQQPGSELVRPGASVKLSCKASGYTFTSYWMHWVKQRHGQGLDWIGNIYPGSGNTQYGEKFKSKGTLTVDTSSSTAYMHLSSLTSEDSAVYYCTRRDANFEGFAYWGQGTLVTVSAASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRDEIMRSFSLSTNLQESLRSKE

SEQ ID NO: 343 - DNA, 1833 bp, artificial
  Synthetic
caggtccaactgcagcaacctgggtctgagctggtgaggcctggagcttcagtgaagctgtcctgcaaggcttctggctacacattcaccagttactggatgcactgggtgaaacagaggcatggacaaggccttgactggattggaaatatttatcctggtagtggtaatactcagtacggtgagaagttcaagagcaagggcacactgactgtagacacatcctccagcacagcctacatgcacctcagcagcctgacatctgaagactctgcggtctattactgtacaagaagggatgctaatttcgagggttttgcttattggggccaggggactctggtcactgtctctgcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagatgaaatcatgagatctttttctttgtcaacaaacttgcaagaaagtttaagaagtaaggaa

SEQ ID NO: 344 - protein, 213 aa, artificial
  Synthetic
QIVLTQSPAIMSASPGEKVTMTCSVSSSVRFMHWYQQKSGTSPKRWIYDTSKLASGVPARFSGSGSGTSYSLTISSMEAEDAATYYCQQWSSNPPTFGGGTKLKIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 345 - protein, 452 aa, artificial
  Synthetic
EVQLQQSGPELVKPGASVKISCKTSGYTFTEYTMHWVKQSHGKSLEWIGGINPNNGGTTYNQKFKGKATLTVDKSSSTAYMELRSLTSQDSAVYYCARDYYRYGHYYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 346 - DNA, 639 bp, artificial
  Synthetic
caaattgttctcacccagtctccagcaatcatgtctgcttctccaggggagaaggtcaccatgacctgcagtgtcagctcaagtgttcgtttcatgcactggtaccagcagaagtcaggcacctcccccaaaagatggatttatgacacatccaaactggcttctggagtccctgctcgcttcagtggcagtgggtctgggacctcttactctctcacaatcagcagcatggaggctgaagatgctgccacttattactgccagcagtggagtagtaacccacccacgttcggaggggggaccaagctgaaaataaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagttcaccggtgacaaagagcttcaacaggggagagtgt

SEQ ID NO: 347 - DNA, 1356 bp, artificial
  Synthetic
gaggtccagctgcaacagtctggacctgagctggtgaaacctggggcttcagtgaaaatatcctgcaagacttctggatacacattcactgaatacaccatgcactgggtgaagcagagccatggaaagagccttgagtggattggcggtattaatcctaacaatggtggtactacctacaaccagaagttcaagggcaaggccacattgactgtagacaagtcctccagcacagcctacatggagctccgcagcctgacatctcaggattctgcagtctattactgtgcaagagactactataggtacggccattactatgctatggactactggggtcaaggaacctcagtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 348 - protein, 623 aa, artificial
  Synthetic
EVQLQQSGPELVKPGASVKISCKTSGYTFTEYTMHWVKQSHGKSLEWIGGINPNNGGTTYNQKFKGKATLTVDKSSSTAYMELRSLTSQDSAVYYCARDYYRYGHYYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGGSCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRGEIMRSFSLSTNLQESLRSKE

SEQ ID NO: 349 - DNA, 1869 bp, artificial
  Synthetic
gaggtccagctgcaacagtctggacctgagctggtgaaacctggggcttcagtgaaaatatcctgcaagacttctggatacacattcactgaatacaccatgcactgggtgaagcagagccatggaaagagccttgagtggattggcggtattaatcctaacaatggtggtactacctacaaccagaagttcaagggcaaggccacattgactgtagacaagtcctccagcacagcctacatggagctccgcagcctgacatctcaggattctgcagtctattactgtgcaagagactactataggtacggccattactatgctatggactactggggtcaaggaacctcagtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatccggaggcggcgggagctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagaggagaaatcatgagatctttttctttgtcaacaaacttgcaagaaagtttaagaagtaaggaa

SEQ ID NO: 350 - protein, 620 aa, artificial
  Synthetic
EVQLQQSGPELVKPGASVKISCKTSGYTFTEYTMHWVKQSHGKSLEWIGGINPNNGGTTYNQKFKGKATLTVDKSSSTAYMELRSLTSQDSAVYYCARDYYRYGHYYAMDYWGQGTSVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKSGGGGSCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRGEIMRSFSLSTNLQESLRSKE

SEQ ID NO: 351 - DNA, 1860 bp, artificial
  Synthetic
gaggtccagctgcaacagtctggacctgagctggtgaaacctggggcttcagtgaaaatatcctgcaagacttctggatacacattcactgaatacaccatgcactgggtgaagcagagccatggaaagagccttgagtggattggcggtattaatcctaacaatggtggtactacctacaaccagaagttcaagggcaaggccacattgactgtagacaagtcctccagcacagcctacatggagctccgcagcctgacatctcaggattctgcagtctattactgtgcaagagactactataggtacggccattactatgctatggactactggggtcaaggaacctcagtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatccggaggcggcgggagctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagaggagaaatcatgagatctttttctttgtcaacaaacttgcaagaaagtttaagaagtaaggaa

SEQ ID NO: 352 - protein, 614 aa, artificial
  Synthetic
EVQLQQSGPELVKPGASVKISCKTSGYTFTEYTMHWVKQSHGKSLEWIGGINPNNGGTTYNQKFKGKATLTVDKSSSTAYMELRSLTSQDSAVYYCARDYYRYGHYYAMDYWGQGTSVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRDEIMRSFSLSTNLQESLRSKE

SEQ ID NO: 353 - DNA, 1842 bp, artificial
  Synthetic
gaggtccagctgcaacagtctggacctgagctggtgaaacctggggcttcagtgaaaatatcctgcaagacttctggatacacattcactgaatacaccatgcactgggtgaagcagagccatggaaagagccttgagtggattggcggtattaatcctaacaatggtggtactacctacaaccagaagttcaagggcaaggccacattgactgtagacaagtcctccagcacagcctacatggagctccgcagcctgacatctcaggattctgcagtctattactgtgcaagagactactataggtacggccattactatgctatggactactggggtcaaggaacctcagtcaccgtctcctcagctagcaccaagggcccatcggtcttccccctggcgccctgctccaggagcacctccgagagcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaatgtagatcacaagcccagcaacaccaaggtggacaagagagttgagtccaaatatggtcccccatgcccaccatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggtaaatgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagatgaaatcatgagatctttttctttgtcaacaaacttgcaagaaagtttaagaagtaaggaa

SEQ ID NO: 354 - protein, 396 aa, artificial
  Synthetic
EVQLQQSGPELVKPGASVKISCKTSGYTFTEYTMHWVKQSHGKSLEWIGGINPNNGGTTYNQKFKGKATLTVDKSSSTAYMELRSLTSQDSAVYYCARDYYRYGHYYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCSGGGGSCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 355 - DNA, 1188 bp, artificial
  Synthetic
gaggtccagctgcaacagtctggacctgagctggtgaaacctggggcttcagtgaaaatatcctgcaagacttctggatacacattcactgaatacaccatgcactgggtgaagcagagccatggaaagagccttgagtggattggcggtattaatcctaacaatggtggtactacctacaaccagaagttcaagggcaaggccacattgactgtagacaagtcctccagcacagcctacatggagctccgcagcctgacatctcaggattctgcagtctattactgtgcaagagactactataggtacggccattactatgctatggactactggggtcaaggaacctcagtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgttccggaggcggcgggagctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaa

SEQ ID NO: 356 - protein, 396 aa, artificial
  Synthetic
EVQLQQSGPELVKPGASVKISCKTSGYTFTEYTMHWVKQSHGKSLEWIGGINPNNGGTTYNQKFKGKATLTVDKSSSTAYMELRSLTSQDSAVYYCARDYYRYGHYYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCSGGGGSCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRDEIMRSFSLSTNLQESLRSKE

SEQ ID NO: 357 - DNA, 1188 bp, artificial
  Synthetic
gaggtccagctgcaacagtctggacctgagctggtgaaacctggggcttcagtgaaaatatcctgcaagacttctggatacacattcactgaatacaccatgcactgggtgaagcagagccatggaaagagccttgagtggattggcggtattaatcctaacaatggtggtactacctacaaccagaagttcaagggcaaggccacattgactgtagacaagtcctccagcacagcctacatggagctccgcagcctgacatctcaggattctgcagtctattactgtgcaagagactactataggtacggccattactatgctatggactactggggtcaaggaacctcagtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgttccggaggcggcgggagctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagatgaaatcatgagatctttttctttgtcaacaaacttgcaagaaagtttaagaagtaaggaa

SEQ ID NO: 358 - protein, 587 aa, artificial
  Synthetic
EVQLQQSGPELVKPGASVKISCKTSGYTFTEYTMHWVKQSHGKSLEWIGGINPNNGGTTYNQKFKGKATLTVDKSSSTAYMELRSLTSQDSAVYYCARDYYRYGHYYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGGSHKCDITLQEIIKTLNSLTEQKTLCTELTVTDIFAASKNTTEKETFCRAATVLRQFYSHHEKDTRCLGATAQQFHRHKQLIRFLKRLDQNLWGLAGLNSCPVKEANQSTLENFLERLKTIMREKYSKCSS

SEQ ID NO: 359 - DNA, 1761 bp, artificial
  Synthetic
gaggtccagctgcaacagtctggacctgagctggtgaaacctggggcttcagtgaaaatatcctgcaagacttctggatacacattcactgaatacaccatgcactgggtgaagcagagccatggaaagagccttgagtggattggcggtattaatcctaacaatggtggtactacctacaaccagaagttcaagggcaaggccacattgactgtagacaagtcctccagcacagcctacatggagctccgcagcctgacatctcaggattctgcagtctattactgtgcaagagactactataggtacggccattactatgctatggactactggggtcaaggaacctcagtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatccggaggaggaggaagccataagtgcgacatcaccctgcaggagatcattaagaccctgaacagcctgactgagcagaaaaccctgtgtacagaactgacagtgactgatatttttgccgcttctaagaacactaccgagaaagaaaccttctgcagggcagccacagtgctgcgccagttttattcccaccatgaaaaggacactcggtgtctgggcgctaccgcacagcagttccaccgacataagcagctgatccggtttctgaaacggctggatcaaaacctgtggggactggcaggcctgaacagctgtccagtgaaagaggccaaccagagtaccctggaaaacttcctggagagactgaaaacaattatgcgagagaaatactcaaaatgtagcagc

SEQ ID NO: 360 - protein, 652 aa, artificial
  Synthetic
EVQLQQSGPELVKPGASVKISCKTSGYTFTEYTMHWVKQSHGKSLEWIGGINPNNGGTTYNQKFKGKATLTVDKSSSTAYMELRSLTSQDSAVYYCARDYYRYGHYYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGGSGGGGSGGGGSPVPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 361 - DNA, 1956 bp, artificial
  Synthetic
gaggtccagctgcaacagtctggacctgagctggtgaaacctggggcttcagtgaaaatatcctgcaagacttctggatacacattcactgaatacaccatgcactgggtgaagcagagccatggaaagagccttgagtggattggcggtattaatcctaacaatggtggtactacctacaaccagaagttcaagggcaaggccacattgactgtagacaagtcctccagcacagcctacatggagctccgcagcctgacatctcaggattctgcagtctattactgtgcaagagactactataggtacggccattactatgctatggactactggggtcaaggaacctcagtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatccggaggtggaggttcagggggagggggctctggaggcggcgggagcccagtacccccaggagaagattccaaagatgtagccgccccacacagacagccactcacctcttcagaacgaattgacaaacaaattcggtacatcctcgacggcatctcagccctgagaaaggagacatgtaacaagagtaacatgtgtgaaagcagcaaagaggcactggcagaaaacaacctgaaccttccaaagatggctgaaaaagatggatgcttccaatctggattcaatgaggagacttgcctggtgaaaatcatcactggtcttttggagtttgaggtatacctggagtacctccagaacagatttgagagtagtgaggaacaagccagagctgtgcagatgagtacaaaagtcctgatccagttcctgcagaaaaaggcaaagaatctggatgcaataaccacccctgacccaaccacaaatgccagcctgctgacgaagctgcaggcacagaaccagtggctgcaggacatgacaactcatctcattctgcgcagctttaaggagttcctgcagtccagcctgagggctcttcggcaaatg

SEQ ID NO: 362 - protein, 652 aa, artificial [sequence omitted]

SEQ ID NO: 363 - DNA, 1956 bp, artificial
  Synthetic
gaggtccagctgcaacagtctggacctgagctggtgaaacctggggcttcagtgaaaatatcctgcaagacttctggatacacattcactgaatacaccatgcactgggtgaagcagagccatggaaagagccttgagtggattggcggtattaatcctaacaatggtggtactacctacaaccagaagttcaagggcaaggccacattgactgtagacaagtcctccagcacagcctacatggagctccgcagcctgacatctcaggattctgcagtctattactgtgcaagagactactataggtacggccattactatgctatggactactggggtcaaggaacctcagtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatccggaggtggaggttcagggggagggggctctggaggcggcgggagcccagtacccccaggagaagattccaaagatgtagccgccccacacagacagccactcacctcttcagaacgaattgacaaacaaattcggtacatcctcgacggcatctcagccctgagaaaggagacatgtaacaagagtaacatgtgtgaaagcagcaaagaggcactggcagaaaacaacctgaaccttccaaagatggctgaaaaagatggatgcttccaatctggattcaatgaggagacttgcctggtgaaaatcatcactggtcttttggagtttgaggtatacctggagtacctccagaacagatttgagagtagtgaggaacaagccagagctgtgcagatgagtacaaaagtcctgatccagttcctgcagaaaaaggcaaagaatctggatgcaataaccacccctgacccaaccacaaatgccagcctgctgacgaagctgcaggcacagaaccagtggctgcaggacatgacaactcatctcattctgcgcagctttaaggagttcctgcagtccagcctggaggctcttcggcaaatg

SEQ ID NO: 364 - protein, 214 aa, homo sapiens
EIVLTQSPATLSASPGERATLSCRASQSISSNLAWYQQKPGQAPRLLIQDSSTRATGIPARFSGSGSGTEFTLTISSLQSEDFAVYYCQQSDNWPLTFGGGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 365 - protein, 455 aa, homo sapiens
QVQLVQSGAEVKKPGSSVKVSCKASGGNFISYSISWVRQAPGKRLEWMGWIIPIFGTTTYVQKFQGRVTITADESTSTAYMELSSLRSEDTAVYYCARVKYGSGSYYPNNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 366 - DNA, 642 bp, homo sapiens
gaaattgtgttgacgcagtctccagccaccctgtctgcgtctccaggggaaagagccaccctctcctgcagggccagtcagagtattagcagcaacttagcctggtaccagcagaagcctggccaggctcccaggctcctcatccaggattcatccaccagggccactggtatcccagccaggttcagtggcagtgggtctgggacagagttcactctcaccatcagcagcctgcagtctgaagattttgcagtttattactgtcagcagtctgataactggcccctcactttcggcggagggaccaaagtggatatcaaacgtacggtggcggcgcccagcgtgttcatcttcccacccagcgacgagcagctgaagtccggcacagccagcgtggtgtgcctgctgaacaacttctacccccgcgaggccaaggtgcagtggaaggtggacaacgccctgcagagcggcaacagccaggaaagcgtgaccgagcaggacagcaaggactccacctacagcctgagcagcaccctgaccctgagcaaggccgactacgagaagcacaaggtgtacgcctgcgaagtgacccaccagggcctgtccagccccgtgaccaagagcttcaaccggggcgagtgc

SEQ ID NO: 367 - DNA, 1365 bp, homo sapiens
caggtccagctggtacagtctggggctgaggtgaagaagcctgggtcctcggtgaaagtctcctgcaaggcttctggaggcaacttcatcagttatagtataagttgggtgcgacaggcccctggaaagcggcttgagtggatgggatggatcatccctatatttggaacaacaacttacgtacagaagttccagggcagagtcacgattaccgcggacgaatccacgagcacagcctacatggagctgagcagcctgagatctgaggacacggccgtgtattactgtgcgagagtaaaatacggttcggggagttattaccctaataactggttcgacccctggggccagggaaccctggtcaccgtctcctcagctagcaccaagggacccagcgtgttccccctggcccccagcagcaagagcacatctggcggaacagccgccctgggctgcctggtgaaagactacttccccgagcccgtgaccgtgagctggaacagcggagccctgaccagcggcgtgcacacctttccagccgtgctgcagagcagcggcctgtacagcctgagcagcgtggtgacagtgccctctagcagcctgggcacccagacctacatctgcaacgtgaaccacaagcccagcaacaccaaggtggacaaaaaggtggaacccaagagctgcgacaagacccacacctgtcccccctgccctgcccctgaactgctgggcggaccctccgtgttcctgttccccccaaagcccaaggacaccctgatgatcagccggacccccgaagtgacctgcgtggtggtggacgtgtcccacgaggaccctgaagtgaagttcaattggtacgtggacggcgtggaagtgcacaacgccaagaccaagcccagagaggaacagtacaacagcacctaccgggtggtgtccgtgctgaccgtgctgcaccaggactggctgaacggcaaagagtacaagtgcaaggtgtccaacaaggccctgcctgctcccatcgagaaaaccatcagcaaggccaagggccagccccgcgagcctcaggtgtacacactgccccccagccgggacgagctgaccaagaaccaggtgtccctgacctgtctggtgaaaggcttctaccccagcgatatcgccgtggaatgggagagcaacggccagcccgagaacaactacaagaccaccccccctgtgctggacagcgacggctcattcttcctgtacagcaagctgaccgtggacaagagccggtggcagcagggcaacgtgttcagctgcagcgtgatgcacgaggccctgcacaaccactacacccagaagtccctgagcctgagccccggcaag

SEQ ID NO: 368 - protein, 219 aa, homo sapiens
DVVMTQSPLSLPVTPGEPASISCRSSQSLLNSNGYNYLEWYVQKPGQSPQLLIFLGSNRASGVPDRFSGSGSGTDFTLKINRVEAEDVGVYYCMQALQSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 369 - protein, 453 aa, homo sapiens
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARDSSSWYFTYGYFQHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 370 - DNA, 657 bp, homo sapiens
gatgttgtgatgactcagtctccactctccctgcccgtcacccctggagagccggcctccatctcctgcaggtctagtcagagcctcctcaatagtaatggatacaactatttggagtggtacgtgcagaagccagggcagtctccacagctcctgatctttttgggttctaatcgggcctccggggtccctgacaggttcagtggcagtggatcaggcacagatttcacactgaaaatcaacagagtggaggctgaggatgttggggtttattactgcatgcaagctctacaaagtcctctcactttcggcggagggaccaaggtggaaatcaaacgtacggtggcggcgcccagcgtgttcatcttcccacccagcgacgagcagctgaagtccggcacagccagcgtggtgtgcctgctgaacaacttctacccccgcgaggccaaggtgcagtggaaggtggacaacgccctgcagagcggcaacagccaggaaagcgtgaccgagcaggacagcaaggactccacctacagcctgagcagcaccctgaccctgagcaaggccgactacgagaagcacaaggtgtacgcctgcgaagtgacccaccagggcctgtccagccccgtgaccaagagcttcaaccggggcgagtgc

SEQ ID NO: 371 - DNA, 1359 bp, homo sapiens
caggtccagcttgtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgagagatagcagcagctggtacttcacgtacggatacttccagcactggggccagggcaccctggtcaccgtctcctcagctagcaccaagggacccagcgtgttccccctggcccccagcagcaagagcacatctggcggaacagccgccctgggctgcctggtgaaagactacttccccgagcccgtgaccgtgagctggaacagcggagccctgaccagcggcgtgcacacctttccagccgtgctgcagagcagcggcctgtacagcctgagcagcgtggtgacagtgccctctagcagcctgggcacccagacctacatctgcaacgtgaaccacaagcccagcaacaccaaggtggacaaaaaggtggaacccaagagctgcgacaagacccacacctgtcccccctgccctgcccctgaactgctgggcggaccctccgtgttcctgttccccccaaagcccaaggacaccctgatgatcagccggacccccgaagtgacctgcgtggtggtggacgtgtcccacgaggaccctgaagtgaagttcaattggtacgtggacggcgtggaagtgcacaacgccaagaccaagcccagagaggaacagtacaacagcacctaccgggtggtgtccgtgctgaccgtgctgcaccaggactggctgaacggcaaagagtacaagtgcaaggtgtccaacaaggccctgcctgctcccatcgagaaaaccatcagcaaggccaagggccagccccgcgagcctcaggtgtacacactgccccccagccgggacgagctgaccaagaaccaggtgtccctgacctgtctggtgaaaggcttctaccccagcgatatcgccgtggaatgggagagcaacggccagcccgagaacaactacaagaccaccccccctgtgctggacagcgacggctcattcttcctgtacagcaagctgaccgtggacaagagccggtggcagcagggcaacgtgttcagctgcagcgtgatgcacgaggccctgcacaaccactacacccagaagtccctgagcctgagccccggcaag

SEQ ID NO: 372 - protein, 220 aa, artificial
  Synthetic
SYGQFTLTQPKSVSGSLRSTITIPCERSSGDIGDNYVSWYQQHLGRPPINVIYADDQRPSEVSDRFSGSIDSSSNSASLTITNLQMDDEADYFCQSYDSNIDIIFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 373 - protein, 449 aa, artificial
  Synthetic
QVQLKESGPGLVQPSETLSLTCTVSGFSLTSYGVNWVRQPPGKGLEWMGRIWNDGSIDYNSALKSRLSISRDTSKGQVFLKMNSLQTEDTAIYFCARGPYNNYWYFDFWGPGTMVTVLSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 374 - protein, 220 aa, artificial
  Synthetic
SYGQFTLTQPKSVSGSLRSTITIPCERSSGDIGDNYVTWYQQHLGRPPLNVIYADDQRPSEVSDRFSGSIDSSSNSASLTITNLQMDDEADYFCQSYDSNTDIIFGGGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 375 - protein, 449 aa, artificial
  Synthetic
QVQLKESGPGLLLSSETLSLTCTVSGFSLTSYEVSWVRQLPGRGLEWMGRVWIGGDTDYNSDLKSRLSISRDIAKSQVFLKMSNLKTEDTGTYYCARAYGFNYWSFDFWGPGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 376 - protein, 214 aa, artificial
  Synthetic
NIVLTQSPATLSVTPGESVSLSCRASQSIGTSIHWYQQKSNESPRLLIRYASQSISGIPSRFSGSGSGTDFTLSINRVESEDFSIYYCQQSYSSLVTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 377 - protein, 452 aa, artificial
  Synthetic
QIQLVQSGPGLKKPGESVKISCKASGYTFTDYSMHWVKQAPGKGLQWMGWINTYSGKPTYAADFKGRFVFSLEASASTANLQISNLKNEDTATYFCARCYDGTFYYDPMDAWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 378 - protein, 599 aa, artificial
  Synthetic
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKAAAGGGSQDPYVKEAENLKKYFNAGHSDVNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRGRRASQ

SEQ ID NO: 379 - DNA, 1797 bp, artificial
  Synthetic
caggtacaactgcagcagcctggggctgagctggtgaagcctggggcctcagtgaagatgtcctgcaaggcttctggctacacatttaccagttacaatatgcactgggtaaaacagacacctggtcggggcctggaatggattggagctatttatcccggaaatggtgatacttcctacaatcagaagttcaaaggcaaggccacattgactgcagacaaatcctccagcacagcctacatgcagctcagcagcctgacatctgaggactctgcggtctattactgtgcaagatcgacttactacggcggtgactggtacttcaatgtctggggcgcagggaccacggtcaccgtctctgcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaagctgccgccggcggagggagccaggacccatatgtaaaagaagcagaaaaccttaagaaatattttaatgcaggtcattcagatgtaaatggaactcttttcttaggcattttgaagaattggaaagaggagagtgacagaaaaataatgcagagccaaattgtctccttttacttcaaactttttaaaaactttaaagatgaccagagcatccaaaagagtgtggagaccatcaaggaagacatgaatgtcaagtttttcaatagcaacaaaaagaaacgagatgacttcgaaaagctgactaattattcggtaactgacttgaatgtccaacgcaaagcaatacatgaactcatccaagtgatggctgaactgtcgccagcagctaaaacagggaagcgaaaaaggagtcagatgctgtttcgaggtcgaagagcatcccag

SEQ ID NO: 380 - protein, 601 aa, artificial [sequence omitted]

SEQ ID NO: 381 - DNA, 1803 bp, artificial
  Synthetic
cagctgcagctgcaggagtcgggcccaggactggtgaagccttcggagaccctgtccctcacctgcactgtctctggtggctccatcagcagtagtagttactactggagctggatccgccagcacccagggaagggcctggagtggattgggtacatctattacagtgggagcaccaactacaacccctccctcaagagtcgagtcaccatatcagttgacacgttgaagaaccagatctccctcagactgacttctgtgaccgctgcggacacggccgtgtattactgtgcgagagtcgggggagccggtggctggcccatggacgtctggggccaagggaccacggtcaccgtctcctcagctagcaccaagggacccagcgtgttccccctggcccccagcagcaagagcacatctggcggaacagccgccctgggctgcctggtgaaagactacttccccgagcccgtgaccgtgagctggaacagcggagccctgaccagcggcgtgcacacctttccagccgtgctgcagagcagcggcctgtacagcctgagcagcgtggtgacagtgccctctagcagcctgggcacccagacctacatctgcaacgtgaaccacaagcccagcaacaccaaggtggacaaaaaggtggaacccaagagctgcgacaagacccacacctgtcccccctgccctgcccctgaactgctgggcggaccctccgtgttcctgttccccccaaagcccaaggacaccctgatgatcagccggacccccgaagtgacctgcgtggtggtggacgtgtcccacgaggaccctgaagtgaagttcaattggtacgtggacggcgtggaagtgcacaacgccaagaccaagcccagagaggaacagtacaacagcacctaccgggtggtgtccgtgctgaccgtgctgcaccaggactggctgaacggcaaagagtacaagtgcaaggtgtccaacaaggccctgcctgctcccatcgagaaaaccatcagcaaggccaagggccagccccgcgagcctcaggtgtacacactgccccccagccgggacgagctgaccaagaaccaggtgtccctgacctgtctggtgaaaggcttctaccccagcgatatcgccgtggaatgggagagcaacggccagcccgagaacaactacaagaccaccccccctgtgctggacagcgacggctcattcttcctgtacagcaagctgaccgtggacaagagccggtggcagcagggcaacgtgttcagctgcagcgtgatgcacgaggccctgcacaaccactacacccagaagtccctgagcctgagccccggcaaggctgccgccggcggagggagccaggacccatatgtaaaagaagcagaaaaccttaagaaatattttaatgcaggtcatatcgatgtagcggataatggaactcttttcttaggcattttgaagaattggaaagaggagagtgacagaaaaataatgcagagccaaattgtctccttttacttcaaactttttaaaaactttaaagatgaccagagcatccaaaagagtgtggagaccatcaaggaagacatgaatgtcaagtttttcaatagcaacaaaaagaaacgagatgacttcgaaaagctgactaattattcggtaactgacttgaatgtccaacgcaaagcaatacatgaactcatccaagtgatggctgaactgtcgccagcagctaaaacagggaagcgaaaaaggagtcagatgctgtttcgaggtcgaagagcatcccag

SEQ ID NO: 382 - protein, 600 aa, artificial
  Synthetic
EVQLQQSGPEVGRPGSSVKISCKASGYTFTDSVMNWVKQSPGQGLEWIGWIDPEYGRTDVAEKFKKKATLTADSSSSTAYIYLSGLTSEDTATYFCARTKYNSGYGFPYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKAAAGGGSQDPYVKEAENLKKYFNAGHSKVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRGRRASQ

SEQ ID NO: 383 - protein, 1800 aa, artificial
  Synthetic
GAAGTCCAGCTGCAGCAGTCTGGGCCTGAGGTTGGGAGGCCTGGGTCCTCAGTCAAGATTTCTTGCAAGGCTTCTGGCTACACCTTTACAGATTCCGTTATGAACTGGGTGAAGCAGAGTCCTGGACAGGGGCTGGAATGGATAGGATGGATTGATCCTGAGTATGGTAGAACTGATGTTGCTGAGAAGTTCAAAAAGAAGGCCACACTGACTGCAGATTCATCCTCCAGCACAGCCTACATCTACCTTAGTGGCCTGACATCTGAGGACACAGCCACCTATTTTTGTGCTAGGACAAAGTATAATTCGGGGTACGGGTTTCCTTACTGGGGCCAAGGCTCTCTGGTCACTGTCTCTTCAGCTAGCACCAAGGGACCCAGCGTGTTCCCCCTGGCCCCCAGCAGCAAGAGCACATCTGGCGGAACAGCCGCCCTGGGCTGCCTGGTGAAAGACTACTTCCCCGAGCCCGTGACCGTGAGCTGGAACAGCGGAGCCCTGACCAGCGGCGTGCACACCTTTCCAGCCGTGCTGCAGAGCAGCGGCCTGTACAGCCTGAGCAGCGTGGTGACAGTGCCCTCTAGCAGCCTGGGCACCCAGACCTACATCTGCAACGTGAACCACAAGCCCAGCAACACCAAGGTGGACAAAAAGGTGGAACCCAAGAGCTGCGACAAGACCCACACCTGTCCCCCCTGCCCTGCCCCTGAACTGCTGGGCGGACCCTCCGTGTTCCTGTTCCCCCCAAAGCCCAAGGACACCCTGATGATCAGCCGGACCCCCGAAGTGACCTGCGTGGTGGTGGACGTGTCCCACGAGGACCCTGAAGTGAAGTTCAATTGGTACGTGGACGGCGTGGAAGTGCACAACGCCAAGACCAAGCCCAGAGAGGAACAGTACAACAGCACCTACCGGGTGGTGTCCGTGCTGACCGTGCTGCACCAGGACTGGCTGAACGGCAAAGAGTACAAGTGCAAGGTGTCCAACAAGGCCCTGCCTGCTCCCATCGAGAAAACCATCAGCAAGGCCAAGGGCCAGCCCCGCGAGCCTCAGGTGTACACACTGCCCCCCAGCCGGGACGAGCTGACCAAGAACCAGGTGTCCCTGACCTGTCTGGTGAAAGGCTTCTACCCCAGCGATATCGCCGTGGAATGGGAGAGCAACGGCCAGCCCGAGAACAACTACAAGACCACCCCCCCTGTGCTGGACAGCGACGGCTCATTCTTCCTGTACAGCAAGCTGACCGTGGACAAGAGCCGGTGGCAGCAGGGCAACGTGTTCAGCTGCAGCGTGATGCACGAGGCCCTGCACAACCACTACACCCAGAAGTCCCTGAGCCTGAGCCCCGGCAAGGCTGCCGCCGGCGGAGGGAGCCAGGACCCATATGTAAAAGAAGCAGAAAACCTTAAGAAATATTTTAATGCAGGTCATTCAAAGGTAGCGGATAATGGAACTCTTTTCTTAGGCATTTTGAAGAATTGGAAAGAGGAGAGTGACAGAAAAATAATGCAGAGCCAAATTGTCTCCTTTTACTTCAAACTTTTTAAAAACTTTAAAGATGACCAGAGCATCCAAAAGAGTGTGGAGACCATCAAGGAAGACATGAATGTCAAGTTTTTCAATAGCAACAAAAAGAAACGAGATGACTTCGAAAAGCTGACTAATTATTCGGTAACTGACTTGAATGTCCAACGCAAAGCAATACATGAACTCATCCAAGTGATGGCTGAACTGTCGCCAGCAGCTAAAACAGGGAAGCGAAAAAGGAGTCAGATGCTGTTTCGAGGTCGAAGAGCATCCCAG

SEQ ID NO: 384 - protein, 107 aa, homo sapiens [sequence omitted]

SEQ ID NO: 385 - protein, 122 aa, homo sapiens [sequence omitted]

SEQ ID NO: 386 - protein, 106 aa, homo sapiens
DIELTQPPSVSVAPGQTARISCSGDNIGNKYVSWYQQKPGQAPVVVIYGDNNRPSGIPERFSGSNSGNTATLTISGTQAEDEADYYCSSYDSSYFVFGGGTKLTVL

SEQ ID NO: 387 - protein, 122 aa, homo sapiens
QVQLVESGGGLVQPGGSLRLSCAASGFTFSSYGMHWVRQAPGKGLEWVSNIYSDGSNTFYADSVKGRFTISRDNSKNTLYLQMNSLRAEDTAVYYCARNMYRWPFHYFFDYWGQGTLVTVSS

SEQ ID NO: 388 - protein, 107 aa, artificial [sequence omitted]

SEQ ID NO: 389 - protein, 120 aa, artificial [sequence omitted]

SEQ ID NO: 390 - protein, 116 aa, homo sapiens
QAVLTQPASLSASPGESARLTCTLPSDINVRYYNIYWYQQKPGSPPRYLLYYYSDSHKGQGSGVPSRFSGSKDVSTNSGILLISGLQSEDEADYYCMTWSSNGSGVFGGGTQLTVL

SEQ ID NO: 391 - protein, 121 aa, homo sapiens
QLQLQESGPGLVKPSETLSLTCTVSGGSISSSSYYWSWIRQHPGKGLEWIGYIYYSGSTNYNPSLKSRVTISVDTLKNQISLRLTSVTAADTAVYYCARVGGAGGWPMDVWGQGTTVTVSS

SEQ ID NO: 392 - protein, 108 aa, homo sapiens
AIQMTQSPSSLSASVGDRVTITCRASQSISSYLNWYQQKPGKAPKLLIYAASSLQSGVPSRFSGSGSGTDFTLTISSLQPEDFATYYCQQSYFTPLYTFGQGTKLEIK

SEQ ID NO: 393 - protein, 118 aa, homo sapiens
QVQLQESGPGLVKPSETLSLTCAVYGGSFSGYYWSWIRQPPGKGLEWIGSIYHSGSTYYNPSLKSRVTISVDTSKNQFSLKLSSVTAADTAVYYCARDLYYYYGMDVWGQGTTVTVSS

SEQ ID NO: 394 - protein, 116 aa, homo sapiens
QAVLTQPASLSASPGESARLTCTLPSDINVRYYNIYWYQQKPGSPPRYLLYYYSDSHKDQGSGVPSRFSGSKDTSANTGILLISGLQSEDEADYYCMIWASNGSGVLGGGTQLTVL

SEQ ID NO: 395 - protein, 122 aa, homo sapiens
EVQLVQSGAEVKKSGASVKVSCKASGYTFTDYYIHWVRQAPGQGLEWMGWINPNNGGVTFAQKFQGRVTMTRDTSISTAYMDLSSLRSDDTAVYFCARDIRMSGWLAPFDYWGQGTLVTVSS

SEQ ID NO: 396 - protein, 116 aa, homo sapiens
QAVLTQPASLSASPGESARLTCTLPSDINVRYHNIYWYQEKPGSPPRYLLYYYSDSSKGQGSGVPSRFSGSKDVSTNTGILVISGLQSEDEAEYYCMTWSSNGSGVFGGGTQLTVL

SEQ ID NO: 397 - protein, 120 aa, homo sapiens
QVQLVESGGGVVQGGGSLRLSCAASGFTVRSNYMSWVRQAPGKGLEWVSAISGSGDSTYYADSVKGRFTISRDNSKNTLYLQMNSLRAEDTAVYYCAKVAVTTGWYFDLWGRGTLVTVSS

SEQ ID NO: 398 - protein, 107 aa, rat
DIQMTQSPASLSASLGETVTIECRASEDIYSNLAWYQQKPGNSPQLLIYDANSLADGVPSRFSASGSGTQFSLKINSLRSEDVASYFCQQYNNYPYTFGAGTKLELK

SEQ ID NO: 399 - protein, 120 aa, rat
EVQLQQSGPEVGRPGSSVKISCKASGYTFTDYIMHWVKQSPGQGLEWIGWIDPEYGRTDYAEKFKKKATLTADTSSSTAYIQLSSLASEDTATYFCARSAHTTGFGFAYWGQGTLVTVSS

SEQ ID NO: 400 - protein, 112 aa, rat
DIVMTQGALPNPVPSGESASITCQSSESLLHSNGKTYLNWYLQRPGQSPQLLIYWMSTRAAGVSDRFSGSGSGTDFTLTISGVEAEDVGVYYCQQFLEYPPTFGSGTKLEIK

SEQ ID NO: 401 - protein, 123 aa, rat
EVQLQQSGPEVGRPGSSVKISCKASGYIFTDYIMHWVKQSPGQGLEWIGWIDPEYGSTDYAEKFKKKATLTADTSSSTAYIQLSSLTSEDTATYFCARVAIITTVASGGFAYWGQGTLVTVSS

SEQ ID NO: 402 - protein, 107 aa, rat
DIVMTQSPTSISISVGERVTMNCKASQNVDSDVDWYQQKTGQSPKLLIYKASNRYTGVPDRFTGSGSGTDFTFTISNMQAEDLAVYYCMQSNTHPRTFGGGTKLELK

SEQ ID NO: 403 - protein, 120 aa, rat
EVQLQQSGPEVGRPGSSVKISCKASGYTFTDSVMNWVKQSPGQGLEWIGWIDPEYGRTDVAEKFKKKATLTADSSSSTAYIYLSGLTSEDTATYFCARTKYNSGYGFPYWGQGSLVTVSS

SEQ ID NO: 404 - protein, 106 aa, mouse [sequence omitted]

SEQ ID NO: 405 - protein, 121 aa, mouse [sequence omitted]

SEQ ID NO: 406 - protein, 106 aa, artificial
  Synthetic
DIQMTQSPSTLSASVGDRVTITCKCQLSVGYMHWYQQKPGKAPKLLIYDTSKLASGVPSRFSGSGSGTEFTLTISSLQPDDFATYYCFQGSGYPFTFGGGTKLEIK

SEQ ID NO: 407 - protein, 120 aa, artificial
  Synthetic
QVTLRESGPALVKPTQTLTLTCTFSGFSLSTSGMSVGWIRQPPGKALEWLADIWWDDKKDYNPSLKSRLTISKDTSKNQVVLKVTNMDPADTATYYCARSMITNWYFDVWGAGTTVTVSS

SEQ ID NO: 408 - protein, 107 aa, mouse
DIQMTQSPASLSASVGETVTLTCRASENIHNYLAWYQQKQGKSPQLLVYNVKTLADGVPSRFSGSGSGTQYSLKINSLQPEDFGSYYCQHFWSSPWTFGGGTKVEIK

SEQ ID NO: 409 - protein, 119 aa, mouse
DVQLQESGPGLVKPSQSLSLTCTVTGHSITSDYAWNWIRQFPGDKLEWMGYISYSGYTTYNPSLKSRVSITRDTSKNQFFLQLNSVTTEDTATYFCARDLDYGPWFAYWGQGTLVTVSA

SEQ ID NO: 410 - protein, 108 aa, mouse
SIVMTQTPKFLLVSAGDRVTITCKASQSVSNDVAWYQQKPGQSPKLLIYYASNRYTGVPDRFTGSGYGTDFTFTISTVQAEDLAVYFCQQDYSSPPWTFGGGTKLEIR

SEQ ID NO: 411 - protein, 120 aa, mouse
QVQLKQSGPGLVQPSQSLSLTCTVSGFSLTSYGVHWVRQPPGKGLEWLGVIWSGGSTDYNAAFISRLSIRKDNSKSQVFFKMNSLQADDTAIYYCARTFTTSTSAWFAYWGQGTLVTVSA

SEQ ID NO: 412 - protein, 107 aa, mouse
DIQMTQSTSSLSASLGDRVTISCSASQGINNYLNWYQQKPDGTVELLIYYTSTLQSGVPSRFSGSGSGTDYSLTISNLEPEDIGTYYCQQYSKLPRTFGGGTKLEIK

SEQ ID NO: 413 - protein, 122 aa, mouse
QVQLQQSGSELMMPGASVKISCKATGYTFSNYWIEWVKQRPGHGLEWIGEILPGTGRTIYNEKFKGKATFTADISSNTVQMQLSSLTSEDSAVYYCARRDYYGNFYYAMDYWGQGTSVTVSS

SEQ ID NO: 414 - protein, 108 aa, artificial
  Synthetic
SSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVL

SEQ ID NO: 415 - protein, 118 aa, artificial
  Synthetic
QVQLVQSGAEVKKPGSSVKVSCKASGGTFSSYAISWVRQAPGQGLEWMGGIIPIFGTANYAQKFQGRVTITADESTSTAYMELSSLRSDDTAVYYCARALDPITFDSWGQGTLVTVSS

SEQ ID NO: 416 - protein, 107 aa, mouse
DIVMTQSQKFMSTSVGDRVSVPCKASQNVDTHVAWYQQKPGQSPKPLIYSAFYRYSGVPDRFTGSGSGTDFTLTISNVKSEDLAEYFCQQYKNYPFTFGSGTKLEVK

SEQ ID NO: 417 - protein, 119 aa, mouse
QVQLQQPGSELVRPGASVKLSCKASGYTFTSYWMHWVKQRHGQGLDWIGNIYPGSGNTQYGEKFKSKGTLTVDTSSSTAYMHLSSLTSEDSAVYYCTRRDANFEGFAYWGQGTLVTVSA

SEQ ID NO: 418 - protein, 106 aa, mouse
QIVLTQSPAIMSASPGEKVTMTCSVSSSVRFMHWYQQKSGTSPKRWIYDTSKLASGVPARFSGSGSGTSYSLTISSMEAEDAATYYCQQWSSNPPTFGGGTKLKIK

SEQ ID NO: 419 - protein, 122 aa, mouse
EVQLQQSGPELVKPGASVKISCKTSGYTFTEYTMHWVKQSHGKSLEWIGGINPNNGGTTYNQKFKGKATLTVDKSSSTAYMELRSLTSQDSAVYYCARDYYRYGHYYAMDYWGQGTSVTVSS

SEQ ID NO: 420 - protein, 107 aa, homo sapiens
EIVLTQSPATLSASPGERATLSCRASQSISSNLAWYQQKPGQAPRLLIQDSSTRATGIPARFSGSGSGTEFTLTISSLQSEDFAVYYCQQSDNWPLTFGGGTKVDIK

SEQ ID NO: 421 - protein, 125 aa, homo sapiens
QVQLVQSGAEVKKPGSSVKVSCKASGGNFISYSISWVRQAPGKRLEWMGWIIPIFGTTTYVQKFQGRVTITADESTSTAYMELSSLRSEDTAVYYCARVKYGSGSYYPNNWFDPWGQGTLVTVSS

SEQ ID NO: 422 - protein, 112 aa, homo sapiens
DVVMTQSPLSLPVTPGEPASISCRSSQSLLNSNGYNYLEWYVQKPGQSPQLLIFLGSNRASGVPDRFSGSGSGTDFTLKINRVEAEDVGVYYCMQALQSPLTFGGGTKVEIK

SEQ ID NO: 423 - protein, 123 aa, homo sapiens
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARDSSSWYFTYGYFQHWGQGTLVTVSS

SEQ ID NO: 424 - protein, 114 aa, rat
SYGQFTLTQPKSVSGSLRSTITIPCERSSGDIGDNYVSWYQQHLGRPPINVIYADDQRPSEVSDRFSGSIDSSSNSASLTITNLQMDDEADYFCQSYDSNIDIIFGGGTKLTVL

SEQ ID NO: 425 - protein, 119 aa, rat
QVQLKESGPGLVQPSETLSLTCTVSGFSLTSYGVNWVRQPPGKGLEWMGRIWNDGSIDYNSALKSRLSISRDTSKGQVFLKMNSLQTEDTAIYFCARGPYNNYWYFDFWGPGTMVTVLS

SEQ ID NO: 426 - protein, 114 aa, rat
SYGQFTLTQPKSVSGSLRSTITIPCERSSGDIGDNYVTWYQQHLGRPPLNVIYADDQRPSEVSDRFSGSIDSSSNSASLTITNLQMDDEADYFCQSYDSNTDIIFGGGTKVTVL

SEQ ID NO: 427 - protein, 119 aa, rat
QVQLKESGPGLLLSSETLSLTCTVSGFSLTSYEVSWVRQLPGRGLEWMGRVWIGGDTDYNSDLKSRLSISRDIAKSQVFLKMSNLKTEDTGTYYCARAYGFNYWSFDFWGPGTMVTVSS

SEQ ID NO: 428 - protein, 107 aa, rat
NIVLTQSPATLSVTPGESVSLSCRASQSIGTSIHWYQQKSNESPRLLIRYASQSISGIPSRFSGSGSGTDFTLSINRVESEDFSIYYCQQSYSSLVTFGSGTKLEIK

SEQ ID NO: 429 - protein, 122 aa, rat
QIQLVQSGPGLKKPGESVKISCKASGYTFTDYSMHWVKQAPGKGLQWMGWINTYSGKPTYAADFKGRFVFSLEASASTANLQISNLKNEDTATYFCARCYDGTFYYDPMDAWGQGTSVTVSS

SEQ ID NO: 430 - protein, 297 aa, homo sapiens
MTTPRNSVNGTFPAEPMKGPIAMQSGPKPLFRRMSSLVGPTQSFFMRESKTLGAVQIMNGLFHIALGGLLMIPAGIYAPICVTVWYPLWGGIMYIISGSLLAATEKNSRKCLVKGKMIMNSLSLFAAISGMILSIMDILNIKISHFLKMESLNFIRAHTPYINIYNCEPANPSEKNSPSTQYCYSIQSLFLGILSVMLIFAFFQELVIAGIVENEWKRTCSRPKSNIVLLSAEEKKEQTIEIKEEVVGLTETSSQPKNEEDIEIIPIQEEEEEETETNFPEPPQDQESSPIENDSSP

SEQ ID NO: 431 - protein, 288 aa, homo sapiens
MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 432 - protein, 310 aa, homo sapiens
MRRAALWLWLCALALSLQPALPQIVATNLPPEDQDGSGDDSDNFSGSGAGALQDITLSQQTPSTWKDTQLLTAIPTSPEPTGLEATAASTSTLPAGEGPKEGEAVVLPEVEPGLTAREQEATPRPRETTQLPTTHQASTTTATTAQEPATSHPHRDMQPGHHETSTPAGPSQADLHTPHTEDGGPSATERAAEDGASSQLPAAEGSGEQDFTFETSGENTAVVAVEPDRRNQSPVDQGATGASQGLLDRKEVLGGVIAGGLVGLIFAVCLVGFMLYRMKKKDEGSYSLEEPKQANGGAYQKPTKQEEFYA

SEQ ID NO: 433 - protein, 2322 aa, homo sapiens
MQSGPRPPLPAPGLALALTLTMLARLASAASFFGENHLEVPVATALTDIDLQLQFSTSQPEALLLLAAGPADHLLLQLYSGRLQVRLVLGQEELRLQTPAETLLSDSIPHTVVLTVVEGWATLSVDGFLNASSAVPGAPLEVPYGLFVGGTGTLGLPYLRGTSRPLRGCLHAATLNGRSLLRPLTPDVHEGCAEEFSASDDVALGFSGPHSLAAFPAWGTQDEGTLEFTLTTQSRQAPLAFQAGGRRGDFIYVDIFEGHLRAVVEKGQGTVLLHNSVPVADGQPHEVSVHINAHRLEISVDQYPTHTSNRGVLSYLEPRGSLLLGGLDAEASRHLQEHRLGLTPEATNASLLGCMEDLSVNGQRRGLREALLTRNMAAGCRLEEEEYEDDAYGHYEAFSTLAPEAWPAMELPEPCVPEPGLPPVFANFTQLLTISPLVVAEGGTAWLEWRHVQPTLDLMEAELRKSQVLFSVTRGARHGELELDIPGAQARKMFTLLDVVNRKARFIHDGSEDTSDQLVLEVSVTARVPMPSCLRRGQTYLLPIQVNPVNDPPHIIFPHGSLMVILEHTQKPLGPEVFQAYDPDSACEGLTFQVLGTSSGLPVERRDQPGEPATEFSCRELEAGSLVYVHRGGPAQDLTFRVSDGLQASPPATLKVVAIRPAIQIHRSTGLRLAQGSAMPILPANLSVETNAVGQDVSVLFRVTGALQFGELQKQGAGGVEGAEWWATQAFHQRDVEQGRVRYLSTDPQHHAYDTVENLALEVQVGQEILSNLSFPVTIQRATVWMLRLEPLHTQNTQQETLTTAHLEATLEEAGPSPPTFHYEVVQAPRKGNLQLQGTRLSDGQGFTQDDIQAGRVTYGATARASEAVEDTFRFRVTAPPYFSPLYTFPIHIGGDPDAPVLTNVLLVVPEGGEGVLSADHLFVKSLNSASYLYEVMERPRHGRLAWRGTQDKTTMVTSFTNEDLLRGRLVYQHDDSETTEDDIPFVATRQGESSGDMAWEEVRGVFRVAIQPVNDHAPVQTISRIFHVARGGRRLLTTDDVAFSDADSGFADAQLVLTRKDLLFGSIVAVDEPTRPIYRFTQEDLRKRRVLFVHSGADRGWIQLQVSDGQHQATALLEVQASEPYLRVANGSSLVVPQGGQGTIDTAVLHLDTNLDIRSGDEVHYHVTAGPRWGQLVRAGQPATAFSQQDLLDGAVLYSHNGSLSPRDTMAFSVEAGPVHTDATLQVTIALEGPLAPLKLVRHKKIYVFQGEAAEIRRDQLEAAQEAVPPADIVFSVKSPPSAGYLVMVSRGALADEPPSLDPVQSFSQEAVDTGRVLYLHSRPEAWSDAFSLDVASGLGAPLEGVLVELEVLPAAIPLEAQNFSVPEGGSLTLAPPLLRVSGPYFPTLLGLSLQVLEPPQHGALQKEDGPQARTLSAFSWRMVEEQLIRYVHDGSETLTDSFVLMANASEMDRQSHPVAFTVTVLPVNDQPPILTTNTGLQMWEGATAPIPAEALRSTDGDSGSEDLVYTIEQPSNGRVVLRGAPGTEVRSFTQAQLDGGLVLFSHRGTLDGGFRFRLSDGEHTSPGHFFRVTAQKQVLLSLKGSQTLTVCPGSVQPLSSQTLRASSSAGTDPQLLLYRVVRGPQLGRLFHAQQDSTGEALVNFTQAEVYAGNILYEHEMPPEPFWEAHDTLELQLSSPPARDVAATLAVAVSFEAACPQRPSHLWKNKGLWVPEGQRARITVAALDASNLLASVPSPQRSEHDVLFQVTQFPSRGQLLVSEEPLHAGQPHFLQSQLAAGQLVYAHGGGGTQQDGFHFRAHLQGPAGASVAGPQTSEAFAITVRDVNERPPQPQASVPLRLTRGSRAPISRAQLSVVDPDSAPGEIEYEVQRAPHNGFLSLVGGGLGPVTRFTQADVDSGRLAFVANGSSVAGIFQLSMSDGASPPLPMSLAVDILPSAIEVQLRAPLEVPQALGRSSLSQQQLRVVSDREEPEAAYRLIQGPQYGHLLVGGRPTSAFSQFQIDQGEVVFAFTNFSSSHDHFRVLALARGVNASAVVNVTVRALLHVWAGGPWPQGATLRLDPTVLDAGELANRTGSVPRFRLLEGPRHGRVVRVPRARTEPGGSQLVEQFTQQDLEDGRLGLEVGRPEGRAPGPAGDSLTLELWAQGVPPAVASLDFATEPYNAARPYSVALLSVPEAARTEAGKPESSTPTGEPGPMASSPEPAVAKGGFLSFLEANMFSVIIPMCLVLLLLALILPLLFYLRKRNKTGKHDVQVLTAKPRNGLAGDTETFRKVEPGQAIPLTAVPGQGPPPGGQPDPELLQFCRTPNPALKNGQYWV

SEQ ID NO: 434 - protein, 165 aa, homo sapiens
CDLPQTHSLGSRRTLMLLAQMRRISLFSCLKDRRDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 435 - protein, 166 aa, homo sapiens
CDLPQTHSLGNRRALILLAQMGRISHFSCLKDRHDFGFPEEEFDGHQFQKAQAISVLHEMIQQTFNLFSTEDSSAAWEQSLLEKFSTELYQQLNDLEACVIQEVGVEETPLMNEDSILAVRKYFQRITLYLTEKKYSPCAWEVVRAEIMRSLSFSTNLQKRLRRKD

SEQ ID NO: 436 - protein, 622 aa, Artificial Sequence
  Synthetic
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGGSCDLPQTHSLGSRRTLMLLAQMRRISLFSCLKDAHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 437 - DNA, 1866 bp, artificial
  Synthetic
caggtacaactgcagcagcctggggctgagctggtgaagcctggggcctcagtgaagatgtcctgcaaggcttctggctacacatttaccagttacaatatgcactgggtaaaacagacacctggtcggggcctggaatggattggagctatttatcccggaaatggtgatacttcctacaatcagaagttcaaaggcaaggccacattgactgcagacaaatcctccagcacagcctacatgcagctcagcagcctgacatctgaggactctgcggtctattactgtgcaagatcgacttactacggcggtgactggtacttcaatgtctggggcgcagggaccacggtcaccgtctctgcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatccggaggcggcgggagctgtgatctgcctcaaacccacagcctgggtagcaggaggaccttgatgctcctggcacagatgaggagaatctctcttttctcctgcttgaaggacgcacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaa

The invention claimed is:

1. A polypeptide construct, comprising an antibody that specifically binds to CD38, or antigen binding portion thereof, linked to an attenuated interferon (IFN) alpha having an amino acid sequence selected from the group consisting of SEQ ID NO: 40, SEQ ID NO:41, SEQ ID NO: 43, SEQ ID NO: 35, SEQ ID NO: 37, SEQ ID NO: 44, SEQ ID NO: 47, SEQ ID NO: 58, SEQ ID NO: 49 and SEQ ID NO: 68.

2. The polypeptide construct of claim 1, wherein the attenuated IFN alpha is linked to the antibody or antigen binding portion thereof via a peptide bond.

3. The polypeptide construct of claim 1, wherein the attenuated IFN alpha is linked to the antibody or antigen binding portion thereof directly or via a polypeptide linker of 1 to 20 amino acids in length.

4. The polypeptide construct of claim 1, wherein the attenuated IFN alpha is linked to the C-terminus of the light chain or heavy chain constant region of the antibody or antigen binding portion thereof.

5. The polypeptide construct of claim 1, wherein the antibody or antigen binding portion thereof specifically binds to CD38 with an affinity of from about 50 nM to about 1 pM, from about 25 nM to about 1 pM, from about 10 nM to about 1 pM, or from about 5 nM to about 1 pM.

6. The polypeptide construct of claim 1, wherein antigen binding portion of the antibody comprises an Fab fragment.

7. The polypeptide construct of claim 1, wherein the construct has an Antigen-Specificity Index of greater than 50.

8. A composition, comprising the polypeptide construct of claim 1 and a pharmaceutically acceptable carrier or diluent.

9. The polypeptide construct of claim 1, wherein the attenuated IFN alpha has the amino acid sequence of SEQ ID NO: 44.

10. The polypeptide construct of claim 1, wherein the antibody is a human antibody.

11. The polypeptide construct of claim 1, wherein the antibody comprises a human IgG1 heavy chain constant region.

12. A composition, comprising the polypeptide construct of claim 1 and a pharmaceutically acceptable carrier.

13. The polypeptide construct of claim 1, wherein the antibody comprises a human IgG4 heavy chain constant region.

14. The polypeptide construct of claim 13, wherein the wherein the human IgG4 heavy chain constant region comprises a proline at position 228.

15. The polypeptide construct of claim 14, wherein the attenuated IFN alpha has the amino acid sequence of SEQ ID NO: 44.

16. A composition, comprising the polypeptide construct of claim 15 and a pharmaceutically acceptable carrier.

17. The polypeptide construct of claim 13, wherein the attenuated IFN alpha has the amino acid sequence of SEQ ID NO: 44.

18. A composition, comprising the polypeptide construct of claim 17 and a pharmaceutically acceptable carrier.

* * * * *